United States Patent 11,492,591 (UNIVERSAL DONOR STEM CELLS AND RELATED METHODS) - sequence listing, part 25

SEQ ID NO: 808652 - DNA, 20 bp, Artificial
  CRISPR gRNA sequence
gtgcacccgtcacccaaata

SEQ ID NO: 808653 - DNA, 20 bp, Artificial
  CRISPR gRNA sequence
aactcaatatgcagcttttt

SEQ ID NO: 808654 - DNA, 20 bp, Artificial
  CRISPR gRNA sequence
aatatgcagcttttttattc

SEQ ID NO: 808655 - DNA, 20 bp, Artificial
  CRISPR gRNA sequence
ttttattcctcactgccact

SEQ ID NO: 808656 - DNA, 20 bp, Artificial
  CRISPR gRNA sequence
tttattcctcactgccactc

SEQ ID NO: 808657 - DNA, 20 bp, Artificial
  CRISPR gRNA sequence
ttattcctcactgccactcc

SEQ ID NO: 808658 - DNA, 20 bp, Artificial
  CRISPR gRNA sequence
tattcctcactgccactccc

SEQ ID NO: 808659 - DNA, 20 bp, Artificial
  CRISPR gRNA sequence
attcctcactgccactccct

SEQ ID NO: 808660 - DNA, 20 bp, Artificial
  CRISPR gRNA sequence
ttcctcactgccactcccta

SEQ ID NO: 808661 - DNA, 20 bp, Artificial
  CRISPR gRNA sequence
ctcactgccactccctactc

SEQ ID NO: 808662 - DNA, 20 bp, Artificial
  CRISPR gRNA sequence
actgccactccctactctct

SEQ ID NO: 808663 - DNA, 20 bp, Artificial
  CRISPR gRNA sequence
ccactccctactctctcctt

SEQ ID NO: 808664 - DNA, 20 bp, Artificial
  CRISPR gRNA sequence
cctactctctccttctgagt

SEQ ID NO: 808665 - DNA, 20 bp, Artificial
  CRISPR gRNA sequence
ctctctccttctgagtctcc

SEQ ID NO: 808666 - DNA, 20 bp, Artificial
  CRISPR gRNA sequence
tctccttctgagtctcccat

SEQ ID NO: 808667 - DNA, 20 bp, Artificial
  CRISPR gRNA sequence
tccttctgagtctcccatgc

SEQ ID NO: 808668 - DNA, 20 bp, Artificial
  CRISPR gRNA sequence
cttctgagtctcccatgccc

SEQ ID NO: 808669 - DNA, 20 bp, Artificial
  CRISPR gRNA sequence
ctgagtctcccatgcccatt

SEQ ID NO: 808670 - DNA, 20 bp, Artificial
  CRISPR gRNA sequence
tgagtctcccatgcccatta

SEQ ID NO: 808671 - DNA, 20 bp, Artificial
  CRISPR gRNA sequence
agtctcccatgcccattata

SEQ ID NO: 808672 - DNA, 20 bp, Artificial
  CRISPR gRNA sequence
ccatgcccattataccactc

SEQ ID NO: 808673 - DNA, 20 bp, Artificial
  CRISPR gRNA sequence
taccactctgtatgcctttg

SEQ ID NO: 808674 - DNA, 20 bp, Artificial
  CRISPR gRNA sequence
tgtatgcctttgcatatcca

SEQ ID NO: 808675 - DNA, 20 bp, Artificial
  CRISPR gRNA sequence
tatgcctttgcatatccata

SEQ ID NO: 808676 - DNA, 20 bp, Artificial
  CRISPR gRNA sequence
tgcatatccatagcttagct

SEQ ID NO: 808677 - DNA, 20 bp, Artificial
  CRISPR gRNA sequence
gcatatccatagcttagctc

SEQ ID NO: 808678 - DNA, 20 bp, Artificial
  CRISPR gRNA sequence
catatccatagcttagctcc

SEQ ID NO: 808679 - DNA, 20 bp, Artificial
  CRISPR gRNA sequence
agctcccacttacaagtgag

SEQ ID NO: 808680 - DNA, 20 bp, Artificial
  CRISPR gRNA sequence
gctcccacttacaagtgaga

SEQ ID NO: 808681 - DNA, 20 bp, Artificial
  CRISPR gRNA sequence
ccacttacaagtgagaatat

SEQ ID NO: 808682 - DNA, 20 bp, Artificial
  CRISPR gRNA sequence
acaagtgagaatatatggta

SEQ ID NO: 808683 - DNA, 20 bp, Artificial
  CRISPR gRNA sequence
caagtgagaatatatggtat

SEQ ID NO: 808684 - DNA, 20 bp, Artificial
  CRISPR gRNA sequence
ggttttccattcctgagtta

SEQ ID NO: 808685 - DNA, 20 bp, Artificial
  CRISPR gRNA sequence
gttttccattcctgagttac

SEQ ID NO: 808686 - DNA, 20 bp, Artificial
  CRISPR gRNA sequence
tccattcctgagttacttca

SEQ ID NO: 808687 - DNA, 20 bp, Artificial
  CRISPR gRNA sequence
ccattcctgagttacttcac

SEQ ID NO: 808688 - DNA, 20 bp, Artificial
  CRISPR gRNA sequence
cattcctgagttacttcact

SEQ ID NO: 808689 - DNA, 20 bp, Artificial
  CRISPR gRNA sequence
ctgagttacttcacttggaa

SEQ ID NO: 808690 - DNA, 20 bp, Artificial
  CRISPR gRNA sequence
agttacttcacttggaataa

SEQ ID NO: 808691 - DNA, 20 bp, Artificial
  CRISPR gRNA sequence
cttcacttggaataatgacc

SEQ ID NO: 808692 - DNA, 20 bp, Artificial
  CRISPR gRNA sequence
cacttggaataatgacctcc

SEQ ID NO: 808693 - DNA, 20 bp, Artificial
  CRISPR gRNA sequence
acttggaataatgacctcca

SEQ ID NO: 808694 - DNA, 20 bp, Artificial
  CRISPR gRNA sequence
ggaataatgacctccagttc

SEQ ID NO: 808695 - DNA, 20 bp, Artificial
  CRISPR gRNA sequence
gaataatgacctccagttcc

SEQ ID NO: 808696 - DNA, 20 bp, Artificial
  CRISPR gRNA sequence
cagttccatccaagttgttg

SEQ ID NO: 808697 - DNA, 20 bp, Artificial
  CRISPR gRNA sequence
catccaagttgttgcaaaac

SEQ ID NO: 808698 - DNA, 20 bp, Artificial
  CRISPR gRNA sequence
ttgcaaaacacattatctca

SEQ ID NO: 808699 - DNA, 20 bp, Artificial
  CRISPR gRNA sequence
caaaacacattatctcattc

SEQ ID NO: 808700 - DNA, 20 bp, Artificial
  CRISPR gRNA sequence
tctcattctttttcatggct

SEQ ID NO: 808701 - DNA, 20 bp, Artificial
  CRISPR gRNA sequence
attctttttcatggctgagt

SEQ ID NO: 808702 - DNA, 20 bp, Artificial
  CRISPR gRNA sequence
tttttcatggctgagtagta

SEQ ID NO: 808703 - DNA, 20 bp, Artificial
  CRISPR gRNA sequence
tttcatggctgagtagtatt

SEQ ID NO: 808704 - DNA, 20 bp, Artificial
  CRISPR gRNA sequence
ttcatggctgagtagtattc

SEQ ID NO: 808705 - DNA, 20 bp, Artificial
  CRISPR gRNA sequence
tcatggctgagtagtattcc

SEQ ID NO: 808706 - DNA, 20 bp, Artificial
  CRISPR gRNA sequence
catggctgagtagtattcca

SEQ ID NO: 808707 - DNA, 20 bp, Artificial
  CRISPR gRNA sequence
atggctgagtagtattccat

SEQ ID NO: 808708 - DNA, 20 bp, Artificial
  CRISPR gRNA sequence
agtagtattccatggtgtat

SEQ ID NO: 808709 - DNA, 20 bp, Artificial
  CRISPR gRNA sequence
catggtgtatatataccaca

SEQ ID NO: 808710 - DNA, 20 bp, Artificial
  CRISPR gRNA sequence
tctttatccacttattcgtc

SEQ ID NO: 808711 - DNA, 20 bp, Artificial
  CRISPR gRNA sequence
ctttatccacttattcgtca

SEQ ID NO: 808712 - DNA, 20 bp, Artificial
  CRISPR gRNA sequence
tttatccacttattcgtcaa

SEQ ID NO: 808713 - DNA, 20 bp, Artificial
  CRISPR gRNA sequence
tatccacttattcgtcaatg

SEQ ID NO: 808714 - DNA, 20 bp, Artificial
  CRISPR gRNA sequence
atccacttattcgtcaatgg

SEQ ID NO: 808715 - DNA, 20 bp, Artificial
  CRISPR gRNA sequence
tccacttattcgtcaatggg

SEQ ID NO: 808716 - DNA, 20 bp, Artificial
  CRISPR gRNA sequence
attcgtcaatgggatcttag

SEQ ID NO: 808717 - DNA, 20 bp, Artificial
  CRISPR gRNA sequence
ttcgtcaatgggatcttagg

SEQ ID NO: 808718 - DNA, 20 bp, Artificial
  CRISPR gRNA sequence
gtcaatgggatcttaggttg

SEQ ID NO: 808719 - DNA, 20 bp, Artificial
  CRISPR gRNA sequence
aggttggtttcatatctttg

SEQ ID NO: 808720 - DNA, 20 bp, Artificial
  CRISPR gRNA sequence
ggttggtttcatatctttgc

SEQ ID NO: 808721 - DNA, 20 bp, Artificial
  CRISPR gRNA sequence
gtttcatatctttgcaatca

SEQ ID NO: 808722 - DNA, 20 bp, Artificial
  CRISPR gRNA sequence
catatctttgcaatcatgaa

SEQ ID NO: 808723 - DNA, 20 bp, Artificial
  CRISPR gRNA sequence
atatctttgcaatcatgaat

SEQ ID NO: 808724 - DNA, 20 bp, Artificial
  CRISPR gRNA sequence
tgcaatcatgaataggtttt

SEQ ID NO: 808725 - DNA, 20 bp, Artificial
  CRISPR gRNA sequence
gcaatcatgaataggttttc

SEQ ID NO: 808726 - DNA, 20 bp, Artificial
  CRISPR gRNA sequence
caatcatgaataggttttca

SEQ ID NO: 808727 - DNA, 20 bp, Artificial
  CRISPR gRNA sequence
tcacttttttcttaacctct

SEQ ID NO: 808728 - DNA, 20 bp, Artificial
  CRISPR gRNA sequence
cacttttttcttaacctctg

SEQ ID NO: 808729 - DNA, 20 bp, Artificial
  CRISPR gRNA sequence
acttttttcttaacctctga

SEQ ID NO: 808730 - DNA, 20 bp, Artificial
  CRISPR gRNA sequence
ttttcttaacctctgatttc

SEQ ID NO: 808731 - DNA, 20 bp, Artificial
  CRISPR gRNA sequence
tttcttaacctctgatttca

SEQ ID NO: 808732 - DNA, 20 bp, Artificial
  CRISPR gRNA sequence
ttcttaacctctgatttcac

SEQ ID NO: 808733 - DNA, 20 bp, Artificial
  CRISPR gRNA sequence
tcttaacctctgatttcaca

SEQ ID NO: 808734 - DNA, 20 bp, Artificial
  CRISPR gRNA sequence
cttaacctctgatttcacat

SEQ ID NO: 808735 - DNA, 20 bp, Artificial
  CRISPR gRNA sequence
ttaacctctgatttcacata

SEQ ID NO: 808736 - DNA, 20 bp, Artificial
  CRISPR gRNA sequence
aacctctgatttcacatatt

SEQ ID NO: 808737 - DNA, 20 bp, Artificial
  CRISPR gRNA sequence
acctctgatttcacatattc

SEQ ID NO: 808738 - DNA, 20 bp, Artificial
  CRISPR gRNA sequence
tgatttcacatattccctcc

SEQ ID NO: 808739 - DNA, 20 bp, Artificial
  CRISPR gRNA sequence
atttcacatattccctccca

SEQ ID NO: 808740 - DNA, 20 bp, Artificial
  CRISPR gRNA sequence
cacatattccctcccactct

SEQ ID NO: 808741 - DNA, 20 bp, Artificial
  CRISPR gRNA sequence
acatattccctcccactctg

SEQ ID NO: 808742 - DNA, 20 bp, Artificial
  CRISPR gRNA sequence
cctcccactctgattctctt

SEQ ID NO: 808743 - DNA, 20 bp, Artificial
  CRISPR gRNA sequence
ccactctgattctcttttag

SEQ ID NO: 808744 - DNA, 20 bp, Artificial
  CRISPR gRNA sequence
tgattctcttttaggattta

SEQ ID NO: 808745 - DNA, 20 bp, Artificial
  CRISPR gRNA sequence
attctcttttaggatttaat

SEQ ID NO: 808746 - DNA, 20 bp, Artificial
  CRISPR gRNA sequence
tcttttaggatttaatgccc

SEQ ID NO: 808747 - DNA, 20 bp, Artificial
  CRISPR gRNA sequence
ttttaggatttaatgcccaa

SEQ ID NO: 808748 - DNA, 20 bp, Artificial
  CRISPR gRNA sequence
ttaggatttaatgcccaact

SEQ ID NO: 808749 - DNA, 20 bp, Artificial
  CRISPR gRNA sequence
taggatttaatgcccaactc

SEQ ID NO: 808750 - DNA, 20 bp, Artificial
  CRISPR gRNA sequence
aggatttaatgcccaactcc

SEQ ID NO: 808751 - DNA, 20 bp, Artificial
  CRISPR gRNA sequence
ggatttaatgcccaactcct

SEQ ID NO: 808752 - DNA, 20 bp, Artificial
  CRISPR gRNA sequence
aatgcccaactcctgccatt

SEQ ID NO: 808753 - DNA, 20 bp, Artificial
  CRISPR gRNA sequence
atgcccaactcctgccattg

SEQ ID NO: 808754 - DNA, 20 bp, Artificial
  CRISPR gRNA sequence
ctgccattgcctgggttcct

SEQ ID NO: 808755 - DNA, 20 bp, Artificial
  CRISPR gRNA sequence
ccattgcctgggttcctgaa

SEQ ID NO: 808756 - DNA, 20 bp, Artificial
  CRISPR gRNA sequence
cctgggttcctgaaatcagt

SEQ ID NO: 808757 - DNA, 20 bp, Artificial
  CRISPR gRNA sequence
ggttcctgaaatcagtccat

SEQ ID NO: 808758 - DNA, 20 bp, Artificial
  CRISPR gRNA sequence
ctgaaatcagtccattccta

SEQ ID NO: 808759 - DNA, 20 bp, Artificial
  CRISPR gRNA sequence
aaatcagtccattcctaatt

SEQ ID NO: 808760 - DNA, 20 bp, Artificial
  CRISPR gRNA sequence
ctaattctgcttttgcccta

SEQ ID NO: 808761 - DNA, 20 bp, Artificial
  CRISPR gRNA sequence
attctgcttttgccctatat

SEQ ID NO: 808762 - DNA, 20 bp, Artificial
  CRISPR gRNA sequence
tgcttttgccctatatacca

SEQ ID NO: 808763 - DNA, 20 bp, Artificial
  CRISPR gRNA sequence
cttttgccctatataccagg

SEQ ID NO: 808764 - DNA, 20 bp, Artificial
  CRISPR gRNA sequence
ttgccctatataccaggttt

SEQ ID NO: 808765 - DNA, 20 bp, Artificial
  CRISPR gRNA sequence
tgccctatataccaggtttt

SEQ ID NO: 808766 - DNA, 20 bp, Artificial
  CRISPR gRNA sequence
gccctatataccaggttttt

SEQ ID NO: 808767 - DNA, 20 bp, Artificial
  CRISPR gRNA sequence
ccctatataccaggttttta

SEQ ID NO: 808768 - DNA, 20 bp, Artificial
  CRISPR gRNA sequence
tataccaggtttttagtaat

SEQ ID NO: 808769 - DNA, 20 bp, Artificial
  CRISPR gRNA sequence
ttagtaattccctcatgact

SEQ ID NO: 808770 - DNA, 20 bp, Artificial
  CRISPR gRNA sequence
tagtaattccctcatgacta

SEQ ID NO: 808771 - DNA, 20 bp, Artificial
  CRISPR gRNA sequence
agtaattccctcatgactat

SEQ ID NO: 808772 - DNA, 20 bp, Artificial
  CRISPR gRNA sequence
gtaattccctcatgactatc

SEQ ID NO: 808773 - DNA, 20 bp, Artificial
  CRISPR gRNA sequence
cctcatgactatcctgagct

SEQ ID NO: 808774 - DNA, 20 bp, Artificial
  CRISPR gRNA sequence
atgactatcctgagcttggc

SEQ ID NO: 808775 - DNA, 20 bp, Artificial
  CRISPR gRNA sequence
tcctgagcttggcctggaat

SEQ ID NO: 808776 - DNA, 20 bp, Artificial
  CRISPR gRNA sequence
agcttggcctggaatttgga

SEQ ID NO: 808777 - DNA, 20 bp, Artificial
  CRISPR gRNA sequence
ggcctggaatttggaggtct

SEQ ID NO: 808778 - DNA, 20 bp, Artificial
  CRISPR gRNA sequence
gcctggaatttggaggtctc

SEQ ID NO: 808779 - DNA, 20 bp, Artificial
  CRISPR gRNA sequence
gaatttggaggtctctattc

SEQ ID NO: 808780 - DNA, 20 bp, Artificial
  CRISPR gRNA sequence
ggaggtctctattcagcact

SEQ ID NO: 808781 - DNA, 20 bp, Artificial
  CRISPR gRNA sequence
gaggtctctattcagcactg

SEQ ID NO: 808782 - DNA, 20 bp, Artificial
  CRISPR gRNA sequence
tattcagcactgtagtctct

SEQ ID NO: 808783 - DNA, 20 bp, Artificial
  CRISPR gRNA sequence
ttcagcactgtagtctcttt

SEQ ID NO: 808784 - DNA, 20 bp, Artificial
  CRISPR gRNA sequence
agcactgtagtctctttcat

SEQ ID NO: 808785 - DNA, 20 bp, Artificial
  CRISPR gRNA sequence
tagtctctttcatgagggtt

SEQ ID NO: 808786 - DNA, 20 bp, Artificial
  CRISPR gRNA sequence
tttcatgagggtttgcattt

SEQ ID NO: 808787 - DNA, 20 bp, Artificial
  CRISPR gRNA sequence
tcatgagggtttgcatttga

SEQ ID NO: 808788 - DNA, 20 bp, Artificial
  CRISPR gRNA sequence
catgagggtttgcatttgaa

SEQ ID NO: 808789 - DNA, 20 bp, Artificial
  CRISPR gRNA sequence
atgagggtttgcatttgaaa

SEQ ID NO: 808790 - DNA, 20 bp, Artificial
  CRISPR gRNA sequence
gcatttgaaaggagcccaat

SEQ ID NO: 808791 - DNA, 20 bp, Artificial
  CRISPR gRNA sequence
catttgaaaggagcccaatg

SEQ ID NO: 808792 - DNA, 20 bp, Artificial
  CRISPR gRNA sequence
gaaaggagcccaatggttaa

SEQ ID NO: 808793 - DNA, 20 bp, Artificial
  CRISPR gRNA sequence
aaaggagcccaatggttaac

SEQ ID NO: 808794 - DNA, 20 bp, Artificial
  CRISPR gRNA sequence
acccataggaattgctcttg

SEQ ID NO: 808795 - DNA, 20 bp, Artificial
  CRISPR gRNA sequence
ctcttgaatgttggcttcag

SEQ ID NO: 808796 - DNA, 20 bp, Artificial
  CRISPR gRNA sequence
ttgaatgttggcttcagtgg

SEQ ID NO: 808797 - DNA, 20 bp, Artificial
  CRISPR gRNA sequence
gaatgttggcttcagtgggt

SEQ ID NO: 808798 - DNA, 20 bp, Artificial
  CRISPR gRNA sequence
aatgttggcttcagtgggta

SEQ ID NO: 808799 - DNA, 20 bp, Artificial
  CRISPR gRNA sequence
gcttcagtgggtacctcatt

SEQ ID NO: 808800 - DNA, 20 bp, Artificial
  CRISPR gRNA sequence
cagtgggtacctcatttatg

SEQ ID NO: 808801 - DNA, 20 bp, Artificial
  CRISPR gRNA sequence
agtgggtacctcatttatgc

SEQ ID NO: 808802 - DNA, 20 bp, Artificial
  CRISPR gRNA sequence
atttatgcctgaggttagtg

SEQ ID NO: 808803 - DNA, 20 bp, Artificial
  CRISPR gRNA sequence
atgcctgaggttagtgctgc

SEQ ID NO: 808804 - DNA, 20 bp, Artificial
  CRISPR gRNA sequence
tgcctgaggttagtgctgcc

SEQ ID NO: 808805 - DNA, 20 bp, Artificial
  CRISPR gRNA sequence
aggttagtgctgccattctc

SEQ ID NO: 808806 - DNA, 20 bp, Artificial
  CRISPR gRNA sequence
gtgctgccattctctgtggg

SEQ ID NO: 808807 - DNA, 20 bp, Artificial
  CRISPR gRNA sequence
ccattctctgtgggccacag

SEQ ID NO: 808808 - DNA, 20 bp, Artificial
  CRISPR gRNA sequence
tctgtgggccacaggtaacc

SEQ ID NO: 808809 - DNA, 20 bp, Artificial
  CRISPR gRNA sequence
tgtgggccacaggtaaccat

SEQ ID NO: 808810 - DNA, 20 bp, Artificial
  CRISPR gRNA sequence
tgggccacaggtaaccataa

SEQ ID NO: 808811 - DNA, 20 bp, Artificial
  CRISPR gRNA sequence
ggtctttaaacctctgtaaa

SEQ ID NO: 808812 - DNA, 20 bp, Artificial
  CRISPR gRNA sequence
gtctttaaacctctgtaaaa

SEQ ID NO: 808813 - DNA, 20 bp, Artificial
  CRISPR gRNA sequence
taaacctctgtaaaattctg

SEQ ID NO: 808814 - DNA, 20 bp, Artificial
  CRISPR gRNA sequence
aaacctctgtaaaattctgg

SEQ ID NO: 808815 - DNA, 20 bp, Artificial
  CRISPR gRNA sequence
aacctctgtaaaattctggc

SEQ ID NO: 808816 - DNA, 20 bp, Artificial
  CRISPR gRNA sequence
tgtaaaattctggctcaatc

SEQ ID NO: 808817 - DNA, 20 bp, Artificial
  CRISPR gRNA sequence
taaaattctggctcaatctt

SEQ ID NO: 808818 - DNA, 20 bp, Artificial
  CRISPR gRNA sequence
tggctcaatcttctagggct

SEQ ID NO: 808819 - DNA, 20 bp, Artificial
  CRISPR gRNA sequence
gctcaatcttctagggctgt

SEQ ID NO: 808820 - DNA, 20 bp, Artificial
  CRISPR gRNA sequence
aatcttctagggctgtgcca

SEQ ID NO: 808821 - DNA, 20 bp, Artificial
  CRISPR gRNA sequence
ctagggctgtgccacttaga

SEQ ID NO: 808822 - DNA, 20 bp, Artificial
  CRISPR gRNA sequence
tagggctgtgccacttagag

SEQ ID NO: 808823 - DNA, 20 bp, Artificial
  CRISPR gRNA sequence
gggctgtgccacttagagtc

SEQ ID NO: 808824 - DNA, 20 bp, Artificial
  CRISPR gRNA sequence
tgccacttagagtctggttc

SEQ ID NO: 808825 - DNA, 20 bp, Artificial
  CRISPR gRNA sequence
agagtctggttcatgggctg

SEQ ID NO: 808826 - DNA, 20 bp, Artificial
  CRISPR gRNA sequence
gagtctggttcatgggctgg

SEQ ID NO: 808827 - DNA, 20 bp, Artificial
  CRISPR gRNA sequence
gttcatgggctggtgctggt

SEQ ID NO: 808828 - DNA, 20 bp, Artificial
  CRISPR gRNA sequence
atgggctggtgctggtaggt

SEQ ID NO: 808829 - DNA, 20 bp, Artificial
  CRISPR gRNA sequence
gtgctggtaggtgaactgtt

SEQ ID NO: 808830 - DNA, 20 bp, Artificial
  CRISPR gRNA sequence
gtaggtgaactgttaccagc

SEQ ID NO: 808831 - DNA, 20 bp, Artificial
  CRISPR gRNA sequence
ttaccagcctatgatgataa

SEQ ID NO: 808832 - DNA, 20 bp, Artificial
  CRISPR gRNA sequence
ccagcctatgatgataactg

SEQ ID NO: 808833 - DNA, 20 bp, Artificial
  CRISPR gRNA sequence
tgatgataactgttccttca

SEQ ID NO: 808834 - DNA, 20 bp, Artificial
  CRISPR gRNA sequence
ttccttcacaagagagttta

SEQ ID NO: 808835 - DNA, 20 bp, Artificial
  CRISPR gRNA sequence
cttcacaagagagtttaaga

SEQ ID NO: 808836 - DNA, 20 bp, Artificial
  CRISPR gRNA sequence
cacaagagagtttaagaaac

SEQ ID NO: 808837 - DNA, 20 bp, Artificial
  CRISPR gRNA sequence
acaagagagtttaagaaaca

SEQ ID NO: 808838 - DNA, 20 bp, Artificial
  CRISPR gRNA sequence
aagaaacactgttctgaaga

SEQ ID NO: 808839 - DNA, 20 bp, Artificial
  CRISPR gRNA sequence
agaaacactgttctgaagat

SEQ ID NO: 808840 - DNA, 20 bp, Artificial
  CRISPR gRNA sequence
ttctgaagatctgaagacat

SEQ ID NO: 808841 - DNA, 20 bp, Artificial
  CRISPR gRNA sequence
tgaagatctgaagacatgtt

SEQ ID NO: 808842 - DNA, 20 bp, Artificial
  CRISPR gRNA sequence
aagatctgaagacatgttct

SEQ ID NO: 808843 - DNA, 20 bp, Artificial
  CRISPR gRNA sequence
aagacatgttctaaagatct

SEQ ID NO: 808844 - DNA, 20 bp, Artificial
  CRISPR gRNA sequence
taaagatctagattctgtag

SEQ ID NO: 808845 - DNA, 20 bp, Artificial
  CRISPR gRNA sequence
aagatctagattctgtagct

SEQ ID NO: 808846 - DNA, 20 bp, Artificial
  CRISPR gRNA sequence
gattctgtagctggtgactt

SEQ ID NO: 808847 - DNA, 20 bp, Artificial
  CRISPR gRNA sequence
tgtagctggtgacttctgct

SEQ ID NO: 808848 - DNA, 20 bp, Artificial
  CRISPR gRNA sequence
tagctggtgacttctgctgg

SEQ ID NO: 808849 - DNA, 20 bp, Artificial
  CRISPR gRNA sequence
gtgacttctgctggattcta

SEQ ID NO: 808850 - DNA, 20 bp, Artificial
  CRISPR gRNA sequence
ctgctggattctaacttgac

SEQ ID NO: 808851 - DNA, 20 bp, Artificial
  CRISPR gRNA sequence
tgctggattctaacttgact

SEQ ID NO: 808852 - DNA, 20 bp, Artificial
  CRISPR gRNA sequence
ctggattctaacttgacttt

SEQ ID NO: 808853 - DNA, 20 bp, Artificial
  CRISPR gRNA sequence
gattctaacttgactttgcc

SEQ ID NO: 808854 - DNA, 20 bp, Artificial
  CRISPR gRNA sequence
taacttgactttgccattgg

SEQ ID NO: 808855 - DNA, 20 bp, Artificial
  CRISPR gRNA sequence
acttgactttgccattggct

SEQ ID NO: 808856 - DNA, 20 bp, Artificial
  CRISPR gRNA sequence
gactttgccattggctcagc

SEQ ID NO: 808857 - DNA, 20 bp, Artificial
  CRISPR gRNA sequence
actttgccattggctcagca

SEQ ID NO: 808858 - DNA, 20 bp, Artificial
  CRISPR gRNA sequence
tgccattggctcagcaagtc

SEQ ID NO: 808859 - DNA, 20 bp, Artificial
  CRISPR gRNA sequence
gccattggctcagcaagtca

SEQ ID NO: 808860 - DNA, 20 bp, Artificial
  CRISPR gRNA sequence
ccattggctcagcaagtcaa

SEQ ID NO: 808861 - DNA, 20 bp, Artificial
  CRISPR gRNA sequence
gctcagcaagtcaatgtata

SEQ ID NO: 808862 - DNA, 20 bp, Artificial
  CRISPR gRNA sequence
agcaagtcaatgtataagtc

SEQ ID NO: 808863 - DNA, 20 bp, Artificial
  CRISPR gRNA sequence
aattattttggattgaaact

SEQ ID NO: 808864 - DNA, 20 bp, Artificial
  CRISPR gRNA sequence
ttttggattgaaacttactt

SEQ ID NO: 808865 - DNA, 20 bp, Artificial
  CRISPR gRNA sequence
tggattgaaacttactttct

SEQ ID NO: 808866 - DNA, 20 bp, Artificial
  CRISPR gRNA sequence
ggattgaaacttactttctc

SEQ ID NO: 808867 - DNA, 20 bp, Artificial
  CRISPR gRNA sequence
gattgaaacttactttctcc

SEQ ID NO: 808868 - DNA, 20 bp, Artificial
  CRISPR gRNA sequence
aaacttactttctccttcca

SEQ ID NO: 808869 - DNA, 20 bp, Artificial
  CRISPR gRNA sequence
actttctccttccattgttc

SEQ ID NO: 808870 - DNA, 20 bp, Artificial
  CRISPR gRNA sequence
ctttctccttccattgttca

SEQ ID NO: 808871 - DNA, 20 bp, Artificial
  CRISPR gRNA sequence
tctccttccattgttcaaag

SEQ ID NO: 808872 - DNA, 20 bp, Artificial
  CRISPR gRNA sequence
ctccttccattgttcaaaga

SEQ ID NO: 808873 - DNA, 20 bp, Artificial
  CRISPR gRNA sequence
tccttccattgttcaaagat

SEQ ID NO: 808874 - DNA, 20 bp, Artificial
  CRISPR gRNA sequence
cttccattgttcaaagataa

SEQ ID NO: 808875 - DNA, 20 bp, Artificial
  CRISPR gRNA sequence
ccattgttcaaagataataa

SEQ ID NO: 808876 - DNA, 20 bp, Artificial
  CRISPR gRNA sequence
cattgttcaaagataataat

SEQ ID NO: 808877 - DNA, 20 bp, Artificial
  CRISPR gRNA sequence
ttcaaagataataatattga

SEQ ID NO: 808878 - DNA, 20 bp, Artificial
  CRISPR gRNA sequence
aaagataataatattgactg

SEQ ID NO: 808879 - DNA, 20 bp, Artificial
  CRISPR gRNA sequence
actgaaccaatttgtattaa

SEQ ID NO: 808880 - DNA, 20 bp, Artificial
  CRISPR gRNA sequence
aaccaatttgtattaagcac

SEQ ID NO: 808881 - DNA, 20 bp, Artificial
  CRISPR gRNA sequence
gtattaagcacttttgcaac

SEQ ID NO: 808882 - DNA, 20 bp, Artificial
  CRISPR gRNA sequence
tattaagcacttttgcaaca

SEQ ID NO: 808883 - DNA, 20 bp, Artificial
  CRISPR gRNA sequence
agcacttttgcaacaaatag

SEQ ID NO: 808884 - DNA, 20 bp, Artificial
  CRISPR gRNA sequence
ttgcaacaaataggccacaa

SEQ ID NO: 808885 - DNA, 20 bp, Artificial
  CRISPR gRNA sequence
tgcaacaaataggccacaag

SEQ ID NO: 808886 - DNA, 20 bp, Artificial
  CRISPR gRNA sequence
gcaacaaataggccacaagt

SEQ ID NO: 808887 - DNA, 20 bp, Artificial
  CRISPR gRNA sequence
caacaaataggccacaagtt

SEQ ID NO: 808888 - DNA, 20 bp, Artificial
  CRISPR gRNA sequence
tggagtcaaacagacctgta

SEQ ID NO: 808889 - DNA, 20 bp, Artificial
  CRISPR gRNA sequence
ggagtcaaacagacctgtat

SEQ ID NO: 808890 - DNA, 20 bp, Artificial
  CRISPR gRNA sequence
gagtcaaacagacctgtatt

SEQ ID NO: 808891 - DNA, 20 bp, Artificial
  CRISPR gRNA sequence
tattcaaatcccagctgtat

SEQ ID NO: 808892 - DNA, 20 bp, Artificial
  CRISPR gRNA sequence
aaatcccagctgtatgactt

SEQ ID NO: 808893 - DNA, 20 bp, Artificial
  CRISPR gRNA sequence
tatgactttgggaagtcata

SEQ ID NO: 808894 - DNA, 20 bp, Artificial
  CRISPR gRNA sequence
tgggaagtcatataactttt

SEQ ID NO: 808895 - DNA, 20 bp, Artificial
  CRISPR gRNA sequence
gggaagtcatataacttttc

SEQ ID NO: 808896 - DNA, 20 bp, Artificial
  CRISPR gRNA sequence
ggaagtcatataacttttct

SEQ ID NO: 808897 - DNA, 20 bp, Artificial
  CRISPR gRNA sequence
ttctgagcctcactttctta

SEQ ID NO: 808898 - DNA, 20 bp, Artificial
  CRISPR gRNA sequence
tctgagcctcactttcttaa

SEQ ID NO: 808899 - DNA, 20 bp, Artificial
  CRISPR gRNA sequence
ctgagcctcactttcttaac

SEQ ID NO: 808900 - DNA, 20 bp, Artificial
  CRISPR gRNA sequence
tgagcctcactttcttaact

SEQ ID NO: 808901 - DNA, 20 bp, Artificial
  CRISPR gRNA sequence
agcctcactttcttaactcc

SEQ ID NO: 808902 - DNA, 20 bp, Artificial
  CRISPR gRNA sequence
actttcttaactccagcata

SEQ ID NO: 808903 - DNA, 20 bp, Artificial
  CRISPR gRNA sequence
tcttaactccagcataaaga

SEQ ID NO: 808904 - DNA, 20 bp, Artificial
  CRISPR gRNA sequence
cttaactccagcataaagac

SEQ ID NO: 808905 - DNA, 20 bp, Artificial
  CRISPR gRNA sequence
ttaactccagcataaagaca

SEQ ID NO: 808906 - DNA, 20 bp, Artificial
  CRISPR gRNA sequence
aactccagcataaagacact

SEQ ID NO: 808907 - DNA, 20 bp, Artificial
  CRISPR gRNA sequence
actccagcataaagacactt

SEQ ID NO: 808908 - DNA, 20 bp, Artificial
  CRISPR gRNA sequence
cagcataaagacacttctcc

SEQ ID NO: 808909 - DNA, 20 bp, Artificial
  CRISPR gRNA sequence
ctccttgccacaagcaattt

SEQ ID NO: 808910 - DNA, 20 bp, Artificial
  CRISPR gRNA sequence
tccttgccacaagcaatttt

SEQ ID NO: 808911 - DNA, 20 bp, Artificial
  CRISPR gRNA sequence
cttgccacaagcaatttttg

SEQ ID NO: 808912 - DNA, 20 bp, Artificial
  CRISPR gRNA sequence
gccacaagcaatttttgtga

SEQ ID NO: 808913 - DNA, 20 bp, Artificial
  CRISPR gRNA sequence
ccacaagcaatttttgtgaa

SEQ ID NO: 808914 - DNA, 20 bp, Artificial
  CRISPR gRNA sequence
ttgtgaaattaaatgagaag

SEQ ID NO: 808915 - DNA, 20 bp, Artificial
  CRISPR gRNA sequence
tgtgaaattaaatgagaagt

SEQ ID NO: 808916 - DNA, 20 bp, Artificial
  CRISPR gRNA sequence
gtgaaattaaatgagaagtt

SEQ ID NO: 808917 - DNA, 20 bp, Artificial
  CRISPR gRNA sequence
tgaaattaaatgagaagttt

SEQ ID NO: 808918 - DNA, 20 bp, Artificial
  CRISPR gRNA sequence
aatgagaagtttgtaaaggg

SEQ ID NO: 808919 - DNA, 20 bp, Artificial
  CRISPR gRNA sequence
gtaaagggtctagcacagtg

SEQ ID NO: 808920 - DNA, 20 bp, Artificial
  CRISPR gRNA sequence
taaagggtctagcacagtgg

SEQ ID NO: 808921 - DNA, 20 bp, Artificial
  CRISPR gRNA sequence
gcacagtggttttcagtaga

SEQ ID NO: 808922 - DNA, 20 bp, Artificial
  CRISPR gRNA sequence
tcagtagaactttctgcaat

SEQ ID NO: 808923 - DNA, 20 bp, Artificial
  CRISPR gRNA sequence
cagtagaactttctgcaatg

SEQ ID NO: 808924 - DNA, 20 bp, Artificial
  CRISPR gRNA sequence
agtagaactttctgcaatga

SEQ ID NO: 808925 - DNA, 20 bp, Artificial
  CRISPR gRNA sequence
tctgcaatgatggaaatgtt

SEQ ID NO: 808926 - DNA, 20 bp, Artificial
  CRISPR gRNA sequence
ctgcaatgatggaaatgttg

SEQ ID NO: 808927 - DNA, 20 bp, Artificial
  CRISPR gRNA sequence
tgcaatgatggaaatgttgt

SEQ ID NO: 808928 - DNA, 20 bp, Artificial
  CRISPR gRNA sequence
caatgatggaaatgttgtat

SEQ ID NO: 808929 - DNA, 20 bp, Artificial
  CRISPR gRNA sequence
tatatctgtactgtccaata

SEQ ID NO: 808930 - DNA, 20 bp, Artificial
  CRISPR gRNA sequence
tactgtccaatacaggagca

SEQ ID NO: 808931 - DNA, 20 bp, Artificial
  CRISPR gRNA sequence
tccaatacaggagcaattat

SEQ ID NO: 808932 - DNA, 20 bp, Artificial
  CRISPR gRNA sequence
tctgtacatggctattgagc

SEQ ID NO: 808933 - DNA, 20 bp, Artificial
  CRISPR gRNA sequence
tacatggctattgagcactt

SEQ ID NO: 808934 - DNA, 20 bp, Artificial
  CRISPR gRNA sequence
ttgagcacttacagtgtgtg

SEQ ID NO: 808935 - DNA, 20 bp, Artificial
  CRISPR gRNA sequence
agcacttacagtgtgtgaat

SEQ ID NO: 808936 - DNA, 20 bp, Artificial
  CRISPR gRNA sequence
acagtgtgtgaatacttaag

SEQ ID NO: 808937 - DNA, 20 bp, Artificial
  CRISPR gRNA sequence
cagtgtgtgaatacttaaga

SEQ ID NO: 808938 - DNA, 20 bp, Artificial
  CRISPR gRNA sequence
aagatgtgactgatgaattt

SEQ ID NO: 808939 - DNA, 20 bp, Artificial
  CRISPR gRNA sequence
agatgtgactgatgaatttt

SEQ ID NO: 808940 - DNA, 20 bp, Artificial
  CRISPR gRNA sequence
atgaatttttatttaactta

SEQ ID NO: 808941 - DNA, 20 bp, Artificial
  CRISPR gRNA sequence
ttatttaacttaaaaagagc

SEQ ID NO: 808942 - DNA, 20 bp, Artificial
  CRISPR gRNA sequence
tatttaacttaaaaagagcc

SEQ ID NO: 808943 - DNA, 20 bp, Artificial
  CRISPR gRNA sequence
atttaacttaaaaagagcca

SEQ ID NO: 808944 - DNA, 20 bp, Artificial
  CRISPR gRNA sequence
tttaacttaaaaagagccac

SEQ ID NO: 808945 - DNA, 20 bp, Artificial
  CRISPR gRNA sequence
aacttaaaaagagccacaga

SEQ ID NO: 808946 - DNA, 20 bp, Artificial
  CRISPR gRNA sequence
acttaaaaagagccacagat

SEQ ID NO: 808947 - DNA, 20 bp, Artificial
  CRISPR gRNA sequence
aaaaagagccacagatggct

SEQ ID NO: 808948 - DNA, 20 bp, Artificial
  CRISPR gRNA sequence
aaaagagccacagatggcta

SEQ ID NO: 808949 - DNA, 20 bp, Artificial
  CRISPR gRNA sequence
ttatattggacagagcagat

SEQ ID NO: 808950 - DNA, 20 bp, Artificial
  CRISPR gRNA sequence
tattggacagagcagatcta

SEQ ID NO: 808951 - DNA, 20 bp, Artificial
  CRISPR gRNA sequence
gacagagcagatctagcata

SEQ ID NO: 808952 - DNA, 20 bp, Artificial
  CRISPR gRNA sequence
gcatactcacctgcatatag

SEQ ID NO: 808953 - DNA, 20 bp, Artificial
  CRISPR gRNA sequence
acctgcatatagtaggttca

SEQ ID NO: 808954 - DNA, 20 bp, Artificial
  CRISPR gRNA sequence
catatagtaggttcaatgtt

SEQ ID NO: 808955 - DNA, 20 bp, Artificial
  CRISPR gRNA sequence
aatgtttaaaatttcattga

SEQ ID NO: 808956 - DNA, 20 bp, Artificial
  CRISPR gRNA sequence
aaaatttcattgaacattta

SEQ ID NO: 808957 - DNA, 20 bp, Artificial
  CRISPR gRNA sequence
aaatttcattgaacatttat

SEQ ID NO: 808958 - DNA, 20 bp, Artificial
  CRISPR gRNA sequence
cattgaacatttattatatg

SEQ ID NO: 808959 - DNA, 20 bp, Artificial
  CRISPR gRNA sequence
attgaacatttattatatgc

SEQ ID NO: 808960 - DNA, 20 bp, Artificial
  CRISPR gRNA sequence
aacatttattatatgccagg

SEQ ID NO: 808961 - DNA, 20 bp, Artificial
  CRISPR gRNA sequence
attatatgccaggtaatttt

SEQ ID NO: 808962 - DNA, 20 bp, Artificial
  CRISPR gRNA sequence
ttatatgccaggtaattttt

SEQ ID NO: 808963 - DNA, 20 bp, Artificial
  CRISPR gRNA sequence
tatgccaggtaattttttag

SEQ ID NO: 808964 - DNA, 20 bp, Artificial
  CRISPR gRNA sequence
tttagacactgggcatatat

SEQ ID NO: 808965 - DNA, 20 bp, Artificial
  CRISPR gRNA sequence
ttagacactgggcatatatt

SEQ ID NO: 808966 - DNA, 20 bp, Artificial
  CRISPR gRNA sequence
tagacactgggcatatattg

SEQ ID NO: 808967 - DNA, 20 bp, Artificial
  CRISPR gRNA sequence
agacactgggcatatattgg

SEQ ID NO: 808968 - DNA, 20 bp, Artificial
  CRISPR gRNA sequence
gacactgggcatatattggt

SEQ ID NO: 808969 - DNA, 20 bp, Artificial
  CRISPR gRNA sequence
ggcatatattggtgaatcag

SEQ ID NO: 808970 - DNA, 20 bp, Artificial
  CRISPR gRNA sequence
gtgaatcagagaaacacagt

SEQ ID NO: 808971 - DNA, 20 bp, Artificial
  CRISPR gRNA sequence
ctgtattcttgaaacgtaaa

SEQ ID NO: 808972 - DNA, 20 bp, Artificial
  CRISPR gRNA sequence
tattcttgaaacgtaaagac

SEQ ID NO: 808973 - DNA, 20 bp, Artificial
  CRISPR gRNA sequence
ttgaaacgtaaagacaagca

SEQ ID NO: 808974 - DNA, 20 bp, Artificial
  CRISPR gRNA sequence
gaaacgtaaagacaagcaga

SEQ ID NO: 808975 - DNA, 20 bp, Artificial
  CRISPR gRNA sequence
aaacgtaaagacaagcagat

SEQ ID NO: 808976 - DNA, 20 bp, Artificial
  CRISPR gRNA sequence
aacattattttgcaacagaa

SEQ ID NO: 808977 - DNA, 20 bp, Artificial
  CRISPR gRNA sequence
acattattttgcaacagaag

SEQ ID NO: 808978 - DNA, 20 bp, Artificial
  CRISPR gRNA sequence
ttttgcaacagaagttgcca

SEQ ID NO: 808979 - DNA, 20 bp, Artificial
  CRISPR gRNA sequence
tgcaacagaagttgccagct

SEQ ID NO: 808980 - DNA, 20 bp, Artificial
  CRISPR gRNA sequence
gcaacagaagttgccagctt

SEQ ID NO: 808981 - DNA, 20 bp, Artificial
  CRISPR gRNA sequence
caacagaagttgccagcttc

SEQ ID NO: 808982 - DNA, 20 bp, Artificial
  CRISPR gRNA sequence
ccagcttcttctctagagcc

SEQ ID NO: 808983 - DNA, 20 bp, Artificial
  CRISPR gRNA sequence
cttctctagagcccagcagg

SEQ ID NO: 808984 - DNA, 20 bp, Artificial
  CRISPR gRNA sequence
ttctctagagcccagcaggt

SEQ ID NO: 808985 - DNA, 20 bp, Artificial
  CRISPR gRNA sequence
ctctagagcccagcaggtca

SEQ ID NO: 808986 - DNA, 20 bp, Artificial
  CRISPR gRNA sequence
tctagagcccagcaggtcac

SEQ ID NO: 808987 - DNA, 20 bp, Artificial
  CRISPR gRNA sequence
tagagcccagcaggtcaccc

SEQ ID NO: 808988 - DNA, 20 bp, Artificial
  CRISPR gRNA sequence
gagcccagcaggtcaccctc

SEQ ID NO: 808989 - DNA, 20 bp, Artificial
  CRISPR gRNA sequence
gagccccaaactgttgaatg

SEQ ID NO: 808990 - DNA, 20 bp, Artificial
  CRISPR gRNA sequence
ttgaatggttcctcttaggg

SEQ ID NO: 808991 - DNA, 20 bp, Artificial
  CRISPR gRNA sequence
aatggttcctcttaggggaa

SEQ ID NO: 808992 - DNA, 20 bp, Artificial
  CRISPR gRNA sequence
ctcttaggggaaaatggtaa

SEQ ID NO: 808993 - DNA, 20 bp, Artificial
  CRISPR gRNA sequence
ttaggggaaaatggtaagca

SEQ ID NO: 808994 - DNA, 20 bp, Artificial
  CRISPR gRNA sequence
aggggaaaatggtaagcagg

SEQ ID NO: 808995 - DNA, 20 bp, Artificial
  CRISPR gRNA sequence
ggggaaaatggtaagcagga

SEQ ID NO: 808996 - DNA, 20 bp, Artificial
  CRISPR gRNA sequence
ttatggaccaataatggctg

SEQ ID NO: 808997 - DNA, 20 bp, Artificial
  CRISPR gRNA sequence
tatggaccaataatggctgc

SEQ ID NO: 808998 - DNA, 20 bp, Artificial
  CRISPR gRNA sequence
atggaccaataatggctgcc

SEQ ID NO: 808999 - DNA, 20 bp, Artificial
  CRISPR gRNA sequence
tggaccaataatggctgccc

SEQ ID NO: 809000 - DNA, 20 bp, Artificial
  CRISPR gRNA sequence
ccctcccaatacactttagt

SEQ ID NO: 809001 - DNA, 20 bp, Artificial
  CRISPR gRNA sequence
ccaatacactttagtacaca

SEQ ID NO: 809002 - DNA, 20 bp, Artificial
  CRISPR gRNA sequence
tagtacacagagctagtcac

SEQ ID NO: 809003 - DNA, 20 bp, Artificial
  CRISPR gRNA sequence
agtacacagagctagtcact

SEQ ID NO: 809004 - DNA, 20 bp, Artificial
  CRISPR gRNA sequence
gtacacagagctagtcactg

SEQ ID NO: 809005 - DNA, 20 bp, Artificial
  CRISPR gRNA sequence
gtcactgaggtataggtggg

SEQ ID NO: 809006 - DNA, 20 bp, Artificial
  CRISPR gRNA sequence
aggtataggtgggtaaatct

SEQ ID NO: 809007 - DNA, 20 bp, Artificial
  CRISPR gRNA sequence
ttcaggagctaagaagccat

SEQ ID NO: 809008 - DNA, 20 bp, Artificial
  CRISPR gRNA sequence
aggagctaagaagccatctg

SEQ ID NO: 809009 - DNA, 20 bp, Artificial
  CRISPR gRNA sequence
agaagccatctggaaggaaa

SEQ ID NO: 809010 - DNA, 20 bp, Artificial
  CRISPR gRNA sequence
gaaggaaagggaccaagcct

SEQ ID NO: 809011 - DNA, 20 bp, Artificial
  CRISPR gRNA sequence
ctgcttctttacttaacttt

SEQ ID NO: 809012 - DNA, 20 bp, Artificial
  CRISPR gRNA sequence
cttctttacttaactttgca

SEQ ID NO: 809013 - DNA, 20 bp, Artificial
  CRISPR gRNA sequence
ctttacttaactttgcaatg

SEQ ID NO: 809014 - DNA, 20 bp, Artificial
  CRISPR gRNA sequence
tttacttaactttgcaatgg

SEQ ID NO: 809015 - DNA, 20 bp, Artificial
  CRISPR gRNA sequence
tacttaactttgcaatggac

SEQ ID NO: 809016 - DNA, 20 bp, Artificial
  CRISPR gRNA sequence
acttaactttgcaatggact

SEQ ID NO: 809017 - DNA, 20 bp, Artificial
  CRISPR gRNA sequence
cttaactttgcaatggacta

SEQ ID NO: 809018 - DNA, 20 bp, Artificial
  CRISPR gRNA sequence
aactttgcaatggactaaga

SEQ ID NO: 809019 - DNA, 20 bp, Artificial
  CRISPR gRNA sequence
actttgcaatggactaagaa

SEQ ID NO: 809020 - DNA, 20 bp, Artificial
  CRISPR gRNA sequence
tgcaatggactaagaaattc

SEQ ID NO: 809021 - DNA, 20 bp, Artificial
  CRISPR gRNA sequence
gcaatggactaagaaattca

SEQ ID NO: 809022 - DNA, 20 bp, Artificial
  CRISPR gRNA sequence
caatggactaagaaattcag

SEQ ID NO: 809023 - DNA, 20 bp, Artificial
  CRISPR gRNA sequence
agaaattcaggataccaatg

SEQ ID NO: 809024 - DNA, 20 bp, Artificial
  CRISPR gRNA sequence
aggataccaatggccctaag

SEQ ID NO: 809025 - DNA, 20 bp, Artificial
  CRISPR gRNA sequence
agaggaactgaagagaagga

SEQ ID NO: 809026 - DNA, 20 bp, Artificial
  CRISPR gRNA sequence
aagagaaggaagttaggact

SEQ ID NO: 809027 - DNA, 20 bp, Artificial
  CRISPR gRNA sequence
ggactggcgtcccaggctca

SEQ ID NO: 809028 - DNA, 20 bp, Artificial
  CRISPR gRNA sequence
gcgtcccaggctcaacatga

SEQ ID NO: 809029 - DNA, 20 bp, Artificial
  CRISPR gRNA sequence
aacatgagggcctagaaggg

SEQ ID NO: 809030 - DNA, 20 bp, Artificial
  CRISPR gRNA sequence
gaagggaagaggctggctgt

SEQ ID NO: 809031 - DNA, 20 bp, Artificial
  CRISPR gRNA sequence
gctgtgtgcagctgtggcta

SEQ ID NO: 809032 - DNA, 20 bp, Artificial
  CRISPR gRNA sequence
tgtgcagctgtggctaaggc

SEQ ID NO: 809033 - DNA, 20 bp, Artificial
  CRISPR gRNA sequence
tggctaaggcagggacctcc

SEQ ID NO: 809034 - DNA, 20 bp, Artificial
  CRISPR gRNA sequence
aggcagggacctcctcctac

SEQ ID NO: 809035 - DNA, 20 bp, Artificial
  CRISPR gRNA sequence
ctcctacctcatcaacccat

SEQ ID NO: 809036 - DNA, 20 bp, Artificial
  CRISPR gRNA sequence
ctacctcatcaacccatagg

SEQ ID NO: 809037 - DNA, 20 bp, Artificial
  CRISPR gRNA sequence
cctcatcaacccataggggt

SEQ ID NO: 809038 - DNA, 20 bp, Artificial
  CRISPR gRNA sequence
atcaacccataggggtcctg

SEQ ID NO: 809039 - DNA, 20 bp, Artificial
  CRISPR gRNA sequence
ctttgggaccaatgacagag

SEQ ID NO: 809040 - DNA, 20 bp, Artificial
  CRISPR gRNA sequence
tgggaccaatgacagagcat

SEQ ID NO: 809041 - DNA, 20 bp, Artificial
  CRISPR gRNA sequence
gggaccaatgacagagcatg

SEQ ID NO: 809042 - DNA, 20 bp, Artificial
  CRISPR gRNA sequence
ggaccaatgacagagcatgt

SEQ ID NO: 809043 - DNA, 20 bp, Artificial
  CRISPR gRNA sequence
gggaaccataagaactgtaa

SEQ ID NO: 809044 - DNA, 20 bp, Artificial
  CRISPR gRNA sequence
taatcttgtagcactgtggt

SEQ ID NO: 809045 - DNA, 20 bp, Artificial
  CRISPR gRNA sequence
gtagcactgtggtctgtgtg

SEQ ID NO: 809046 - DNA, 20 bp, Artificial
  CRISPR gRNA sequence
tagcactgtggtctgtgtgg

SEQ ID NO: 809047 - DNA, 20 bp, Artificial
  CRISPR gRNA sequence
tggtctgtgtggggatcgga

SEQ ID NO: 809048 - DNA, 20 bp, Artificial
  CRISPR gRNA sequence
tgtggggatcggaaccagca

SEQ ID NO: 809049 - DNA, 20 bp, Artificial
  CRISPR gRNA sequence
cctttgcacagtggatggag

SEQ ID NO: 809050 - DNA, 20 bp, Artificial
  CRISPR gRNA sequence
tgcacagtggatggagacat

SEQ ID NO: 809051 - DNA, 20 bp, Artificial
  CRISPR gRNA sequence
gcacagtggatggagacatc

SEQ ID NO: 809052 - DNA, 20 bp, Artificial
  CRISPR gRNA sequence
cacagtggatggagacatct

SEQ ID NO: 809053 - DNA, 20 bp, Artificial
  CRISPR gRNA sequence
gaaggaccagagattctgca

SEQ ID NO: 809054 - DNA, 20 bp, Artificial
  CRISPR gRNA sequence
tgcatggccggagtagacag

SEQ ID NO: 809055 - DNA, 20 bp, Artificial
  CRISPR gRNA sequence
catggccggagtagacagca

SEQ ID NO: 809056 - DNA, 20 bp, Artificial
  CRISPR gRNA sequence
ctcaaaaccagggccctctg

SEQ ID NO: 809057 - DNA, 20 bp, Artificial
  CRISPR gRNA sequence
aaaaccagggccctctggag

SEQ ID NO: 809058 - DNA, 20 bp, Artificial
  CRISPR gRNA sequence
tggaggactaacctagctgc

SEQ ID NO: 809059 - DNA, 20 bp, Artificial
  CRISPR gRNA sequence
gaggactaacctagctgcct

SEQ ID NO: 809060 - DNA, 20 bp, Artificial
  CRISPR gRNA sequence
acctagctgcctagcactgg

SEQ ID NO: 809061 - DNA, 20 bp, Artificial
  CRISPR gRNA sequence
gctgcctagcactggccctg

SEQ ID NO: 809062 - DNA, 20 bp, Artificial
  CRISPR gRNA sequence
cctagcactggccctgtggg

SEQ ID NO: 809063 - DNA, 20 bp, Artificial
  CRISPR gRNA sequence
gcactggccctgtgggctaa

SEQ ID NO: 809064 - DNA, 20 bp, Artificial
  CRISPR gRNA sequence
gccctgtgggctaagtaagc

SEQ ID NO: 809065 - DNA, 20 bp, Artificial
  CRISPR gRNA sequence
tgggctaagtaagctttctg

SEQ ID NO: 809066 - DNA, 20 bp, Artificial
  CRISPR gRNA sequence
agtaagctttctggcagttt

SEQ ID NO: 809067 - DNA, 20 bp, Artificial
  CRISPR gRNA sequence
tctggcagtttgtgggaggt

SEQ ID NO: 809068 - DNA, 20 bp, Artificial
  CRISPR gRNA sequence
ctggcagtttgtgggaggtg

SEQ ID NO: 809069 - DNA, 20 bp, Artificial
  CRISPR gRNA sequence
tggcagtttgtgggaggtgg

SEQ ID NO: 809070 - DNA, 20 bp, Artificial
  CRISPR gRNA sequence
gcagtttgtgggaggtggag

SEQ ID NO: 809071 - DNA, 20 bp, Artificial
  CRISPR gRNA sequence
gtgggaggtggagaagtaca

SEQ ID NO: 809072 - DNA, 20 bp, Artificial
  CRISPR gRNA sequence
tgggaggtggagaagtacat

SEQ ID NO: 809073 - DNA, 20 bp, Artificial
  CRISPR gRNA sequence
taagagggagacactgaact

SEQ ID NO: 809074 - DNA, 20 bp, Artificial
  CRISPR gRNA sequence
aacttcttgctaagatgggc

SEQ ID NO: 809075 - DNA, 20 bp, Artificial
  CRISPR gRNA sequence
cttgctaagatgggcatgtg

SEQ ID NO: 809076 - DNA, 20 bp, Artificial
  CRISPR gRNA sequence
ttgctaagatgggcatgtgg

SEQ ID NO: 809077 - DNA, 20 bp, Artificial
  CRISPR gRNA sequence
gctaagatgggcatgtgggt

SEQ ID NO: 809078 - DNA, 20 bp, Artificial
  CRISPR gRNA sequence
ctaagatgggcatgtgggta

SEQ ID NO: 809079 - DNA, 20 bp, Artificial
  CRISPR gRNA sequence
agatgggcatgtgggtactt

SEQ ID NO: 809080 - DNA, 20 bp, Artificial
  CRISPR gRNA sequence
gaggaatcaattggaaaatt

SEQ ID NO: 809081 - DNA, 20 bp, Artificial
  CRISPR gRNA sequence
aggaatcaattggaaaatta

SEQ ID NO: 809082 - DNA, 20 bp, Artificial
  CRISPR gRNA sequence
gaaaattaaaagggatgcaa

SEQ ID NO: 809083 - DNA, 20 bp, Artificial
  CRISPR gRNA sequence
aaagggatgcaatttaattg

SEQ ID NO: 809084 - DNA, 20 bp, Artificial
  CRISPR gRNA sequence
aattggtagtccaagctatt

SEQ ID NO: 809085 - DNA, 20 bp, Artificial
  CRISPR gRNA sequence
attggtagtccaagctatta

SEQ ID NO: 809086 - DNA, 20 bp, Artificial
  CRISPR gRNA sequence
gtagtccaagctattaaaac

SEQ ID NO: 809087 - DNA, 20 bp, Artificial
  CRISPR gRNA sequence
ttaaaacagatcctagacat

SEQ ID NO: 809088 - DNA, 20 bp, Artificial
  CRISPR gRNA sequence
aaacagatcctagacatgtg

SEQ ID NO: 809089 - DNA, 20 bp, Artificial
  CRISPR gRNA sequence
gacatgtgattgtgtgctga

SEQ ID NO: 809090 - DNA, 20 bp, Artificial
  CRISPR gRNA sequence
tgtgctgagtatactgaaag

SEQ ID NO: 809091 - DNA, 20 bp, Artificial
  CRISPR gRNA sequence
agtatactgaaagaagaagt

SEQ ID NO: 809092 - DNA, 20 bp, Artificial
  CRISPR gRNA sequence
aaagaagaagtaggtgctat

SEQ ID NO: 809093 - DNA, 20 bp, Artificial
  CRISPR gRNA sequence
tggaaacatataataagggg

SEQ ID NO: 809094 - DNA, 20 bp, Artificial
  CRISPR gRNA sequence
aatgtaatgggtgtggtgcg

SEQ ID NO: 809095 - DNA, 20 bp, Artificial
  CRISPR gRNA sequence
atgtaatgggtgtggtgcgt

SEQ ID NO: 809096 - DNA, 20 bp, Artificial
  CRISPR gRNA sequence
ggaaagacttgatgaagtat

SEQ ID NO: 809097 - DNA, 20 bp, Artificial
  CRISPR gRNA sequence
gatgaagtataagcttagct

SEQ ID NO: 809098 - DNA, 20 bp, Artificial
  CRISPR gRNA sequence
atgaagtataagcttagctg

SEQ ID NO: 809099 - DNA, 20 bp, Artificial
  CRISPR gRNA sequence
agctgagatttaaaagatga

SEQ ID NO: 809100 - DNA, 20 bp, Artificial
  CRISPR gRNA sequence
gctgagatttaaaagatgac

SEQ ID NO: 809101 - DNA, 20 bp, Artificial
  CRISPR gRNA sequence
agatttaaaagatgactcca

SEQ ID NO: 809102 - DNA, 20 bp, Artificial
  CRISPR gRNA sequence
aaaagatgactccaactcag

SEQ ID NO: 809103 - DNA, 20 bp, Artificial
  CRISPR gRNA sequence
aaagatgactccaactcagg

SEQ ID NO: 809104 - DNA, 20 bp, Artificial
  CRISPR gRNA sequence
caactcaggtggacaacaag

SEQ ID NO: 809105 - DNA, 20 bp, Artificial
  CRISPR gRNA sequence
aggtggacaacaagaaaaaa

SEQ ID NO: 809106 - DNA, 20 bp, Artificial
  CRISPR gRNA sequence
taagaagagacaatattgta

SEQ ID NO: 809107 - DNA, 20 bp, Artificial
  CRISPR gRNA sequence
aagaagagacaatattgtat

SEQ ID NO: 809108 - DNA, 20 bp, Artificial
  CRISPR gRNA sequence
agaagagacaatattgtatg

SEQ ID NO: 809109 - DNA, 20 bp, Artificial
  CRISPR gRNA sequence
tatgagaaaactcggaattg

SEQ ID NO: 809110 - DNA, 20 bp, Artificial
  CRISPR gRNA sequence
ggaattgaaagactgccatg

SEQ ID NO: 809111 - DNA, 20 bp, Artificial
  CRISPR gRNA sequence
aaagactgccatgcctctga

SEQ ID NO: 809112 - DNA, 20 bp, Artificial
  CRISPR gRNA sequence
ccatgcctctgaggactaga

SEQ ID NO: 809113 - DNA, 20 bp, Artificial
  CRISPR gRNA sequence
tgaggactagaaaatcctgt

SEQ ID NO: 809114 - DNA, 20 bp, Artificial
  CRISPR gRNA sequence
aggactagaaaatcctgtgt

SEQ ID NO: 809115 - DNA, 20 bp, Artificial
  CRISPR gRNA sequence
gaaaatcctgtgtggttaga

SEQ ID NO: 809116 - DNA, 20 bp, Artificial
  CRISPR gRNA sequence
tgtggttagagctttagaca

SEQ ID NO: 809117 - DNA, 20 bp, Artificial
  CRISPR gRNA sequence
gagctttagacaatgaaggt

SEQ ID NO: 809118 - DNA, 20 bp, Artificial
  CRISPR gRNA sequence
tagacaatgaaggtgatggt

SEQ ID NO: 809119 - DNA, 20 bp, Artificial
  CRISPR gRNA sequence
agacaatgaaggtgatggtg

SEQ ID NO: 809120 - DNA, 20 bp, Artificial
  CRISPR gRNA sequence
gacaatgaaggtgatggtga

SEQ ID NO: 809121 - DNA, 20 bp, Artificial
  CRISPR gRNA sequence
aagctggagacatgagtcaa

SEQ ID NO: 809122 - DNA, 20 bp, Artificial
  CRISPR gRNA sequence
gagacatgagtcaaaccatc

SEQ ID NO: 809123 - DNA, 20 bp, Artificial
  CRISPR gRNA sequence
ggctcgttggaacttcatcc

SEQ ID NO: 809124 - DNA, 20 bp, Artificial
  CRISPR gRNA sequence
gttggaacttcatccagtga

SEQ ID NO: 809125 - DNA, 20 bp, Artificial
  CRISPR gRNA sequence
gaacttcatccagtgagcaa

SEQ ID NO: 809126 - DNA, 20 bp, Artificial
  CRISPR gRNA sequence
catccagtgagcaataagaa

SEQ ID NO: 809127 - DNA, 20 bp, Artificial
  CRISPR gRNA sequence
atccagtgagcaataagaag

SEQ ID NO: 809128 - DNA, 20 bp, Artificial
  CRISPR gRNA sequence
gacagaggacacatggtaga

SEQ ID NO: 809129 - DNA, 20 bp, Artificial
  CRISPR gRNA sequence
atgatttttaaaagcctatt

SEQ ID NO: 809130 - DNA, 20 bp, Artificial
  CRISPR gRNA sequence
tgatttttaaaagcctatta

SEQ ID NO: 809131 - DNA, 20 bp, Artificial
  CRISPR gRNA sequence
ttaaaagcctattatagcaa

SEQ ID NO: 809132 - DNA, 20 bp, Artificial
  CRISPR gRNA sequence
taaaagcctattatagcaaa

SEQ ID NO: 809133 - DNA, 20 bp, Artificial
  CRISPR gRNA sequence
aaaagcctattatagcaaaa

SEQ ID NO: 809134 - DNA, 20 bp, Artificial
  CRISPR gRNA sequence
aaagcctattatagcaaaaa

SEQ ID NO: 809135 - DNA, 20 bp, Artificial
  CRISPR gRNA sequence
ttatagcaaaaagtgagaac

SEQ ID NO: 809136 - DNA, 20 bp, Artificial
  CRISPR gRNA sequence
tagcaaaaagtgagaacaga

SEQ ID NO: 809137 - DNA, 20 bp, Artificial
  CRISPR gRNA sequence
gaggtagcaggagtgaatac

SEQ ID NO: 809138 - DNA, 20 bp, Artificial
  CRISPR gRNA sequence
ggaagatttctctgtagtcc

SEQ ID NO: 809139 - DNA, 20 bp, Artificial
  CRISPR gRNA sequence
ctctgtagtccaagttgaac

SEQ ID NO: 809140 - DNA, 20 bp, Artificial
  CRISPR gRNA sequence
tctgtagtccaagttgaacc

SEQ ID NO: 809141 - DNA, 20 bp, Artificial
  CRISPR gRNA sequence
tgtagtccaagttgaaccac

SEQ ID NO: 809142 - DNA, 20 bp, Artificial
  CRISPR gRNA sequence
tagtccaagttgaaccacac

SEQ ID NO: 809143 - DNA, 20 bp, Artificial
  CRISPR gRNA sequence
aaccacactagcggcagtga

SEQ ID NO: 809144 - DNA, 20 bp, Artificial
  CRISPR gRNA sequence
gcggcagtgaagttcggcca

SEQ ID NO: 809145 - DNA, 20 bp, Artificial
  CRISPR gRNA sequence
ggccaataagctgtaaaatg

SEQ ID NO: 809146 - DNA, 20 bp, Artificial
  CRISPR gRNA sequence
taaaatgttccttctcttgc

SEQ ID NO: 809147 - DNA, 20 bp, Artificial
  CRISPR gRNA sequence
cttctcttgctgcttcccct

SEQ ID NO: 809148 - DNA, 20 bp, Artificial
  CRISPR gRNA sequence
ctcttgctgcttcccctttt

SEQ ID NO: 809149 - DNA, 20 bp, Artificial
  CRISPR gRNA sequence
tcttgctgcttcccctttta

SEQ ID NO: 809150 - DNA, 20 bp, Artificial
  CRISPR gRNA sequence
ttgctgcttccccttttaca

SEQ ID NO: 809151 - DNA, 20 bp, Artificial
  CRISPR gRNA sequence
gctgcttccccttttacaga

SEQ ID NO: 809152 - DNA, 20 bp, Artificial
  CRISPR gRNA sequence
ctgcttccccttttacagat

SEQ ID NO: 809153 - DNA, 20 bp, Artificial
  CRISPR gRNA sequence
cttccccttttacagataga

SEQ ID NO: 809154 - DNA, 20 bp, Artificial
  CRISPR gRNA sequence
ccccttttacagatagaaag

SEQ ID NO: 809155 - DNA, 20 bp, Artificial
  CRISPR gRNA sequence
cccttttacagatagaaaga

SEQ ID NO: 809156 - DNA, 20 bp, Artificial
  CRISPR gRNA sequence
ttacagatagaaagaccatc

SEQ ID NO: 809157 - DNA, 20 bp, Artificial
  CRISPR gRNA sequence
tacagatagaaagaccatct

SEQ ID NO: 809158 - DNA, 20 bp, Artificial
  CRISPR gRNA sequence
acagatagaaagaccatctc

SEQ ID NO: 809159 - DNA, 20 bp, Artificial
  CRISPR gRNA sequence
cagatagaaagaccatctca

SEQ ID NO: 809160 - DNA, 20 bp, Artificial
  CRISPR gRNA sequence
aaagaagataggcaatttgt

SEQ ID NO: 809161 - DNA, 20 bp, Artificial
  CRISPR gRNA sequence
gtacaaggtcagaaagccaa

SEQ ID NO: 809162 - DNA, 20 bp, Artificial
  CRISPR gRNA sequence
tacaaggtcagaaagccaac

SEQ ID NO: 809163 - DNA, 20 bp, Artificial
  CRISPR gRNA sequence
gccctctgaccctggtttaa

SEQ ID NO: 809164 - DNA, 20 bp, Artificial
  CRISPR gRNA sequence
tgaccctggtttaaagctct

SEQ ID NO: 809165 - DNA, 20 bp, Artificial
  CRISPR gRNA sequence
accctggtttaaagctctgt

SEQ ID NO: 809166 - DNA, 20 bp, Artificial
  CRISPR gRNA sequence
gtttaaagctctgtctgcat

SEQ ID NO: 809167 - DNA, 20 bp, Artificial
  CRISPR gRNA sequence
aaagctctgtctgcatcacc

SEQ ID NO: 809168 - DNA, 20 bp, Artificial
  CRISPR gRNA sequence
aagctctgtctgcatcacca

SEQ ID NO: 809169 - DNA, 20 bp, Artificial
  CRISPR gRNA sequence
tgtctgcatcaccagcagtt

SEQ ID NO: 809170 - DNA, 20 bp, Artificial
  CRISPR gRNA sequence
tctgcatcaccagcagttct

SEQ ID NO: 809171 - DNA, 20 bp, Artificial
  CRISPR gRNA sequence
catcaccagcagttctcaac

SEQ ID NO: 809172 - DNA, 20 bp, Artificial
  CRISPR gRNA sequence
tcaacccttttccatggcac

SEQ ID NO: 809173 - DNA, 20 bp, Artificial
  CRISPR gRNA sequence
aacccttttccatggcacac

SEQ ID NO: 809174 - DNA, 20 bp, Artificial
  CRISPR gRNA sequence
ttccatggcacacaagtttg

SEQ ID NO: 809175 - DNA, 20 bp, Artificial
  CRISPR gRNA sequence
tccatggcacacaagtttgt

SEQ ID NO: 809176 - DNA, 20 bp, Artificial
  CRISPR gRNA sequence
ccatggcacacaagtttgtg

SEQ ID NO: 809177 - DNA, 20 bp, Artificial
  CRISPR gRNA sequence
catggcacacaagtttgtgt

SEQ ID NO: 809178 - DNA, 20 bp, Artificial
  CRISPR gRNA sequence
gtgtgcatggcagacacatg

SEQ ID NO: 809179 - DNA, 20 bp, Artificial
  CRISPR gRNA sequence
tgtgcatggcagacacatgt

SEQ ID NO: 809180 - DNA, 20 bp, Artificial
  CRISPR gRNA sequence
aatgcaagtgagttggagac

SEQ ID NO: 809181 - DNA, 20 bp, Artificial
  CRISPR gRNA sequence
gagacaagggttatataggc

SEQ ID NO: 809182 - DNA, 20 bp, Artificial
  CRISPR gRNA sequence
tataggcaaccatgatttct

SEQ ID NO: 809183 - DNA, 20 bp, Artificial
  CRISPR gRNA sequence
ctctctggttcattaaaaat

SEQ ID NO: 809184 - DNA, 20 bp, Artificial
  CRISPR gRNA sequence
tctctggttcattaaaaata

SEQ ID NO: 809185 - DNA, 20 bp, Artificial
  CRISPR gRNA sequence
tctggttcattaaaaatata

SEQ ID NO: 809186 - DNA, 20 bp, Artificial
  CRISPR gRNA sequence
tggttcattaaaaatataaa

SEQ ID NO: 809187 - DNA, 20 bp, Artificial
  CRISPR gRNA sequence
gttcattaaaaatataaaag

SEQ ID NO: 809188 - DNA, 20 bp, Artificial
  CRISPR gRNA sequence
attaaaaatataaaagaaat

SEQ ID NO: 809189 - DNA, 20 bp, Artificial
  CRISPR gRNA sequence
aaaatataaaagaaattgtt

SEQ ID NO: 809190 - DNA, 20 bp, Artificial
  CRISPR gRNA sequence
tttgcacatttattcactta

SEQ ID NO: 809191 - DNA, 20 bp, Artificial
  CRISPR gRNA sequence
gcacatttattcacttaatt

SEQ ID NO: 809192 - DNA, 20 bp, Artificial
  CRISPR gRNA sequence
cacatttattcacttaattc

SEQ ID NO: 809193 - DNA, 20 bp, Artificial
  CRISPR gRNA sequence
attcacttaattcttatttg

SEQ ID NO: 809194 - DNA, 20 bp, Artificial
  CRISPR gRNA sequence
ttcacttaattcttatttgt

SEQ ID NO: 809195 - DNA, 20 bp, Artificial
  CRISPR gRNA sequence
acttaattcttatttgtaag

SEQ ID NO: 809196 - DNA, 20 bp, Artificial
  CRISPR gRNA sequence
aattcttatttgtaagaaag

SEQ ID NO: 809197 - DNA, 20 bp, Artificial
  CRISPR gRNA sequence
attcttatttgtaagaaagg

SEQ ID NO: 809198 - DNA, 20 bp, Artificial
  CRISPR gRNA sequence
ttatttgtaagaaaggtctc

SEQ ID NO: 809199 - DNA, 20 bp, Artificial
  CRISPR gRNA sequence
atttgtaagaaaggtctcct

SEQ ID NO: 809200 - DNA, 20 bp, Artificial
  CRISPR gRNA sequence
tttgtaagaaaggtctccta

SEQ ID NO: 809201 - DNA, 20 bp, Artificial
  CRISPR gRNA sequence
gtaagaaaggtctcctaatc

SEQ ID NO: 809202 - DNA, 20 bp, Artificial
  CRISPR gRNA sequence
taagaaaggtctcctaatca

SEQ ID NO: 809203 - DNA, 20 bp, Artificial
  CRISPR gRNA sequence
ctaatcacagttagaacttg

SEQ ID NO: 809204 - DNA, 20 bp, Artificial
  CRISPR gRNA sequence
atcacagttagaacttgagc

SEQ ID NO: 809205 - DNA, 20 bp, Artificial
  CRISPR gRNA sequence
gaacttgagctttacctccc

SEQ ID NO: 809206 - DNA, 20 bp, Artificial
  CRISPR gRNA sequence
gagctttacctcccagctcg

SEQ ID NO: 809207 - DNA, 20 bp, Artificial
  CRISPR gRNA sequence
agctttacctcccagctcgg

SEQ ID NO: 809208 - DNA, 20 bp, Artificial
  CRISPR gRNA sequence
tacctcccagctcggagcta

SEQ ID NO: 809209 - DNA, 20 bp, Artificial
  CRISPR gRNA sequence
acctcccagctcggagctac

SEQ ID NO: 809210 - DNA, 20 bp, Artificial
  CRISPR gRNA sequence
cctcccagctcggagctact

SEQ ID NO: 809211 - DNA, 20 bp, Artificial
  CRISPR gRNA sequence
ccagctcggagctactgata

SEQ ID NO: 809212 - DNA, 20 bp, Artificial
  CRISPR gRNA sequence
ggagctactgatatcctcac

SEQ ID NO: 809213 - DNA, 20 bp, Artificial
  CRISPR gRNA sequence
ctgatatcctcactcactct

SEQ ID NO: 809214 - DNA, 20 bp, Artificial
  CRISPR gRNA sequence
atatcctcactcactcttaa

SEQ ID NO: 809215 - DNA, 20 bp, Artificial
  CRISPR gRNA sequence
actcactcttaagattgggg

SEQ ID NO: 809216 - DNA, 20 bp, Artificial
  CRISPR gRNA sequence
actcttaagattggggtgaa

SEQ ID NO: 809217 - DNA, 20 bp, Artificial
  CRISPR gRNA sequence
ttaagattggggtgaaggat

SEQ ID NO: 809218 - DNA, 20 bp, Artificial
  CRISPR gRNA sequence
aagattggggtgaaggatga

SEQ ID NO: 809219 - DNA, 20 bp, Artificial
  CRISPR gRNA sequence
agattggggtgaaggatgag

SEQ ID NO: 809220 - DNA, 20 bp, Artificial
  CRISPR gRNA sequence
gggtgaaggatgaggagagg

SEQ ID NO: 809221 - DNA, 20 bp, Artificial
  CRISPR gRNA sequence
atttccactctatctttgag

SEQ ID NO: 809222 - DNA, 20 bp, Artificial
  CRISPR gRNA sequence
tttccactctatctttgagt

SEQ ID NO: 809223 - DNA, 20 bp, Artificial
  CRISPR gRNA sequence
ccactctatctttgagtgtg

SEQ ID NO: 809224 - DNA, 20 bp, Artificial
  CRISPR gRNA sequence
cactctatctttgagtgtga

SEQ ID NO: 809225 - DNA, 20 bp, Artificial
  CRISPR gRNA sequence
tatctttgagtgtgactcca

SEQ ID NO: 809226 - DNA, 20 bp, Artificial
  CRISPR gRNA sequence
tctttgagtgtgactccatt

SEQ ID NO: 809227 - DNA, 20 bp, Artificial
  CRISPR gRNA sequence
tgagtgtgactccattccat

SEQ ID NO: 809228 - DNA, 20 bp, Artificial
  CRISPR gRNA sequence
gagtgtgactccattccatt

SEQ ID NO: 809229 - DNA, 20 bp, Artificial
  CRISPR gRNA sequence
agtgtgactccattccattc

SEQ ID NO: 809230 - DNA, 20 bp, Artificial
  CRISPR gRNA sequence
cattccattctcccaaagac

SEQ ID NO: 809231 - DNA, 20 bp, Artificial
  CRISPR gRNA sequence
cattctcccaaagacagctg

SEQ ID NO: 809232 - DNA, 20 bp, Artificial
  CRISPR gRNA sequence
tcccaaagacagctggaacg

SEQ ID NO: 809233 - DNA, 20 bp, Artificial
  CRISPR gRNA sequence
ccaaagacagctggaacgga

SEQ ID NO: 809234 - DNA, 20 bp, Artificial
  CRISPR gRNA sequence
gaacggaacactcagctgct

SEQ ID NO: 809235 - DNA, 20 bp, Artificial
  CRISPR gRNA sequence
agctgctcatttctgaagtt

SEQ ID NO: 809236 - DNA, 20 bp, Artificial
  CRISPR gRNA sequence
ctcatttctgaagttattaa

SEQ ID NO: 809237 - DNA, 20 bp, Artificial
  CRISPR gRNA sequence
atttctgaagttattaagga

SEQ ID NO: 809238 - DNA, 20 bp, Artificial
  CRISPR gRNA sequence
ctgaagttattaaggagtcc

SEQ ID NO: 809239 - DNA, 20 bp, Artificial
  CRISPR gRNA sequence
tgaagttattaaggagtcct

SEQ ID NO: 809240 - DNA, 20 bp, Artificial
  CRISPR gRNA sequence
aagttattaaggagtcctca

SEQ ID NO: 809241 - DNA, 20 bp, Artificial
  CRISPR gRNA sequence
ttaaggagtcctcaggcccc

SEQ ID NO: 809242 - DNA, 20 bp, Artificial
  CRISPR gRNA sequence
aggagtcctcaggccccagg

SEQ ID NO: 809243 - DNA, 20 bp, Artificial
  CRISPR gRNA sequence
aggccccaggccttgaaccc

SEQ ID NO: 809244 - DNA, 20 bp, Artificial
  CRISPR gRNA sequence
gaaccctgaggtatgggtgt

SEQ ID NO: 809245 - DNA, 20 bp, Artificial
  CRISPR gRNA sequence
aaccctgaggtatgggtgtg

SEQ ID NO: 809246 - DNA, 20 bp, Artificial
  CRISPR gRNA sequence
aggtatgggtgtgagaggta

SEQ ID NO: 809247 - DNA, 20 bp, Artificial
  CRISPR gRNA sequence
aggtgcacctgacacaactc

SEQ ID NO: 809248 - DNA, 20 bp, Artificial
  CRISPR gRNA sequence
acacaactctctgaagtggt

SEQ ID NO: 809249 - DNA, 20 bp, Artificial
  CRISPR gRNA sequence
tctgaagtggttctatttaa

SEQ ID NO: 809250 - DNA, 20 bp, Artificial
  CRISPR gRNA sequence
tgaagtggttctatttaaaa

SEQ ID NO: 809251 - DNA, 20 bp, Artificial
  CRISPR gRNA sequence
aagtggttctatttaaaagt

SEQ ID NO: 809252 - DNA, 20 bp, Artificial
  CRISPR gRNA sequence
tatttaaaagtcgaagttct

SEQ ID NO: 809253 - DNA, 20 bp, Artificial
  CRISPR gRNA sequence
tttaaaagtcgaagttctgt

SEQ ID NO: 809254 - DNA, 20 bp, Artificial
  CRISPR gRNA sequence
aaaagtcgaagttctgttgg

SEQ ID NO: 809255 - DNA, 20 bp, Artificial
  CRISPR gRNA sequence
aaagtcgaagttctgttgga

SEQ ID NO: 809256 - DNA, 20 bp, Artificial
  CRISPR gRNA sequence
tgttggacatacctcctcct

SEQ ID NO: 809257 - DNA, 20 bp, Artificial
  CRISPR gRNA sequence
ttggacatacctcctccttt

SEQ ID NO: 809258 - DNA, 20 bp, Artificial
  CRISPR gRNA sequence
gacatacctcctcctttacc

SEQ ID NO: 809259 - DNA, 20 bp, Artificial
  CRISPR gRNA sequence
ctcctttaccatgaagctcc

SEQ ID NO: 809260 - DNA, 20 bp, Artificial
  CRISPR gRNA sequence
ctttaccatgaagctccctt

SEQ ID NO: 809261 - DNA, 20 bp, Artificial
  CRISPR gRNA sequence
taccatgaagctcccttccc

SEQ ID NO: 809262 - DNA, 20 bp, Artificial
  CRISPR gRNA sequence
accatgaagctcccttccct

SEQ ID NO: 809263 - DNA, 20 bp, Artificial
  CRISPR gRNA sequence
ccatgaagctcccttccctc

SEQ ID NO: 809264 - DNA, 20 bp, Artificial
  CRISPR gRNA sequence
ccttccctcccacatttatt

SEQ ID NO: 809265 - DNA, 20 bp, Artificial
  CRISPR gRNA sequence
ccctcccacatttatttttc

SEQ ID NO: 809266 - DNA, 20 bp, Artificial
  CRISPR gRNA sequence
cctcccacatttatttttct

SEQ ID NO: 809267 - DNA, 20 bp, Artificial
  CRISPR gRNA sequence
ccacatttatttttctttct

SEQ ID NO: 809268 - DNA, 20 bp, Artificial
  CRISPR gRNA sequence
atttttctttctatctttct

SEQ ID NO: 809269 - DNA, 20 bp, Artificial
  CRISPR gRNA sequence
tttttctttctatctttctt

SEQ ID NO: 809270 - DNA, 20 bp, Artificial
  CRISPR gRNA sequence
ttctttctatctttcttctt

SEQ ID NO: 809271 - DNA, 20 bp, Artificial
  CRISPR gRNA sequence
tctttctatctttcttcttc

SEQ ID NO: 809272 - DNA, 20 bp, Artificial
  CRISPR gRNA sequence
ctttctatctttcttcttct

SEQ ID NO: 809273 - DNA, 20 bp, Artificial
  CRISPR gRNA sequence
tttctatctttcttcttctc

SEQ ID NO: 809274 - DNA, 20 bp, Artificial
  CRISPR gRNA sequence
tctatctttcttcttctcca

SEQ ID NO: 809275 - DNA, 20 bp, Artificial
  CRISPR gRNA sequence
ctatctttcttcttctccat

SEQ ID NO: 809276 - DNA, 20 bp, Artificial
  CRISPR gRNA sequence
tatctttcttcttctccatc

SEQ ID NO: 809277 - DNA, 20 bp, Artificial
  CRISPR gRNA sequence
tctttcttcttctccatctc

SEQ ID NO: 809278 - DNA, 20 bp, Artificial
  CRISPR gRNA sequence
tcttcttctccatctcctgt

SEQ ID NO: 809279 - DNA, 20 bp, Artificial
  CRISPR gRNA sequence
cttcttctccatctcctgtt

SEQ ID NO: 809280 - DNA, 20 bp, Artificial
  CRISPR gRNA sequence
ttcttctccatctcctgttt

SEQ ID NO: 809281 - DNA, 20 bp, Artificial
  CRISPR gRNA sequence
cttctccatctcctgttttc

SEQ ID NO: 809282 - DNA, 20 bp, Artificial
  CRISPR gRNA sequence
ttctccatctcctgttttct

SEQ ID NO: 809283 - DNA, 20 bp, Artificial
  CRISPR gRNA sequence
ctccatctcctgttttctct

SEQ ID NO: 809284 - DNA, 20 bp, Artificial
  CRISPR gRNA sequence
tccatctcctgttttctctt

SEQ ID NO: 809285 - DNA, 20 bp, Artificial
  CRISPR gRNA sequence
catctcctgttttctctttc

SEQ ID NO: 809286 - DNA, 20 bp, Artificial
  CRISPR gRNA sequence
ctgttttctctttctccctc

SEQ ID NO: 809287 - DNA, 20 bp, Artificial
  CRISPR gRNA sequence
ttttctctttctccctcact

SEQ ID NO: 809288 - DNA, 20 bp, Artificial
  CRISPR gRNA sequence
tctctttctccctcactccc

SEQ ID NO: 809289 - DNA, 20 bp, Artificial
  CRISPR gRNA sequence
ctctttctccctcactcccc

SEQ ID NO: 809290 - DNA, 20 bp, Artificial
  CRISPR gRNA sequence
tctttctccctcactcccct

SEQ ID NO: 809291 - DNA, 20 bp, Artificial
  CRISPR gRNA sequence
tttctccctcactcccctgg

SEQ ID NO: 809292 - DNA, 20 bp, Artificial
  CRISPR gRNA sequence
tctccctcactcccctggcc

SEQ ID NO: 809293 - DNA, 20 bp, Artificial
  CRISPR gRNA sequence
ctccctcactcccctggcca

SEQ ID NO: 809294 - DNA, 20 bp, Artificial
  CRISPR gRNA sequence
tccctcactcccctggccat

SEQ ID NO: 809295 - DNA, 20 bp, Artificial
  CRISPR gRNA sequence
cctcactcccctggccatct

SEQ ID NO: 809296 - DNA, 20 bp, Artificial
  CRISPR gRNA sequence
actcccctggccatcttctt

SEQ ID NO: 809297 - DNA, 20 bp, Artificial
  CRISPR gRNA sequence
ccctggccatcttcttccct

SEQ ID NO: 809298 - DNA, 20 bp, Artificial
  CRISPR gRNA sequence
gccatcttcttccctccctc

SEQ ID NO: 809299 - DNA, 20 bp, Artificial
  CRISPR gRNA sequence
cttccctccctctgtctttt

SEQ ID NO: 809300 - DNA, 20 bp, Artificial
  CRISPR gRNA sequence
ttccctccctctgtcttttt

SEQ ID NO: 809301 - DNA, 20 bp, Artificial
  CRISPR gRNA sequence
ccctccctctgtctttttct

SEQ ID NO: 809302 - DNA, 20 bp, Artificial
  CRISPR gRNA sequence
cctccctctgtctttttctt

SEQ ID NO: 809303 - DNA, 20 bp, Artificial
  CRISPR gRNA sequence
cctctgtctttttcttttgg

SEQ ID NO: 809304 - DNA, 20 bp, Artificial
  CRISPR gRNA sequence
tgtctttttcttttggcaac

SEQ ID NO: 809305 - DNA, 20 bp, Artificial
  CRISPR gRNA sequence
tctttttcttttggcaacaa

SEQ ID NO: 809306 - DNA, 20 bp, Artificial
  CRISPR gRNA sequence
tttcttttggcaacaattcc

SEQ ID NO: 809307 - DNA, 20 bp, Artificial
  CRISPR gRNA sequence
ttcttttggcaacaattcct

SEQ ID NO: 809308 - DNA, 20 bp, Artificial
  CRISPR gRNA sequence
tcttttggcaacaattcctt

SEQ ID NO: 809309 - DNA, 20 bp, Artificial
  CRISPR gRNA sequence
cttttggcaacaattccttg

SEQ ID NO: 809310 - DNA, 20 bp, Artificial
  CRISPR gRNA sequence
ttttggcaacaattccttgc

SEQ ID NO: 809311 - DNA, 20 bp, Artificial
  CRISPR gRNA sequence
ttggcaacaattccttgcat

SEQ ID NO: 809312 - DNA, 20 bp, Artificial
  CRISPR gRNA sequence
tggcaacaattccttgcatt

SEQ ID NO: 809313 - DNA, 20 bp, Artificial
  CRISPR gRNA sequence
ggcaacaattccttgcattc

SEQ ID NO: 809314 - DNA, 20 bp, Artificial
  CRISPR gRNA sequence
gcaacaattccttgcattct

SEQ ID NO: 809315 - DNA, 20 bp, Artificial
  CRISPR gRNA sequence
cttgcattctacagttagaa

SEQ ID NO: 809316 - DNA, 20 bp, Artificial
  CRISPR gRNA sequence
gcattctacagttagaaata

SEQ ID NO: 809317 - DNA, 20 bp, Artificial
  CRISPR gRNA sequence
cattctacagttagaaatat

SEQ ID NO: 809318 - DNA, 20 bp, Artificial
  CRISPR gRNA sequence
tacagttagaaatattgtgg

SEQ ID NO: 809319 - DNA, 20 bp, Artificial
  CRISPR gRNA sequence
cagttagaaatattgtggtc

SEQ ID NO: 809320 - DNA, 20 bp, Artificial
  CRISPR gRNA sequence
gaaatattgtggtcagcacc

SEQ ID NO: 809321 - DNA, 20 bp, Artificial
  CRISPR gRNA sequence
tggtcagcacccaagtgaat

SEQ ID NO: 809322 - DNA, 20 bp, Artificial
  CRISPR gRNA sequence
tatggcagatgaaaatatag

SEQ ID NO: 809323 - DNA, 20 bp, Artificial
  CRISPR gRNA sequence
atggcagatgaaaatataga

SEQ ID NO: 809324 - DNA, 20 bp, Artificial
  CRISPR gRNA sequence
tggcagatgaaaatatagaa

SEQ ID NO: 809325 - DNA, 20 bp, Artificial
  CRISPR gRNA sequence
tgagtataaatgtaagataa

SEQ ID NO: 809326 - DNA, 20 bp, Artificial
  CRISPR gRNA sequence
aaaattcccctagtcctcag

SEQ ID NO: 809327 - DNA, 20 bp, Artificial
  CRISPR gRNA sequence
aaattcccctagtcctcaga

SEQ ID NO: 809328 - DNA, 20 bp, Artificial
  CRISPR gRNA sequence
ccctagtcctcagatagtgc

SEQ ID NO: 809329 - DNA, 20 bp, Artificial
  CRISPR gRNA sequence
gtcctcagatagtgctgctg

SEQ ID NO: 809330 - DNA, 20 bp, Artificial
  CRISPR gRNA sequence
agatagtgctgctgcaaact

SEQ ID NO: 809331 - DNA, 20 bp, Artificial
  CRISPR gRNA sequence
ctgcaaactcctactgaatt

SEQ ID NO: 809332 - DNA, 20 bp, Artificial
  CRISPR gRNA sequence
caaactcctactgaattatt

SEQ ID NO: 809333 - DNA, 20 bp, Artificial
  CRISPR gRNA sequence
ctactgaattatttccacat

SEQ ID NO: 809334 - DNA, 20 bp, Artificial
  CRISPR gRNA sequence
ctgaattatttccacatgtc

SEQ ID NO: 809335 - DNA, 20 bp, Artificial
  CRISPR gRNA sequence
aattatttccacatgtcatt

SEQ ID NO: 809336 - DNA, 20 bp, Artificial
  CRISPR gRNA sequence
tttccacatgtcatttctct

SEQ ID NO: 809337 - DNA, 20 bp, Artificial
  CRISPR gRNA sequence
ccacatgtcatttctctttc

SEQ ID NO: 809338 - DNA, 20 bp, Artificial
  CRISPR gRNA sequence
cacatgtcatttctctttct

SEQ ID NO: 809339 - DNA, 20 bp, Artificial
  CRISPR gRNA sequence
ctctttctatagatgaggcc

SEQ ID NO: 809340 - DNA, 20 bp, Artificial
  CRISPR gRNA sequence
tctttctatagatgaggcca

SEQ ID NO: 809341 - DNA, 20 bp, Artificial
  CRISPR gRNA sequence
tttctatagatgaggccatg

SEQ ID NO: 809342 - DNA, 20 bp, Artificial
  CRISPR gRNA sequence
tctatagatgaggccatgta

SEQ ID NO: 809343 - DNA, 20 bp, Artificial
  CRISPR gRNA sequence
ctatagatgaggccatgtat

SEQ ID NO: 809344 - DNA, 20 bp, Artificial
  CRISPR gRNA sequence
tatagatgaggccatgtata

SEQ ID NO: 809345 - DNA, 20 bp, Artificial
  CRISPR gRNA sequence
tagatgaggccatgtataga

SEQ ID NO: 809346 - DNA, 20 bp, Artificial
  CRISPR gRNA sequence
tggagaagttcattgagtgc

SEQ ID NO: 809347 - DNA, 20 bp, Artificial
  CRISPR gRNA sequence
ggagaagttcattgagtgca

SEQ ID NO: 809348 - DNA, 20 bp, Artificial
  CRISPR gRNA sequence
gagaagttcattgagtgcag

SEQ ID NO: 809349 - DNA, 20 bp, Artificial
  CRISPR gRNA sequence
attgagtgcagacaagggag

SEQ ID NO: 809350 - DNA, 20 bp, Artificial
  CRISPR gRNA sequence
agtgcagacaagggagccgt

SEQ ID NO: 809351 - DNA, 20 bp, Artificial
  CRISPR gRNA sequence
aggaaagcaccagctaggcc

SEQ ID NO: 809352 - DNA, 20 bp, Artificial
  CRISPR gRNA sequence
ggaaagcaccagctaggcct

SEQ ID NO: 809353 - DNA, 20 bp, Artificial
  CRISPR gRNA sequence
ggcctgcatacattctgggg

SEQ ID NO: 809354 - DNA, 20 bp, Artificial
  CRISPR gRNA sequence
catacattctgggggttttg

SEQ ID NO: 809355 - DNA, 20 bp, Artificial
  CRISPR gRNA sequence
tgggggttttgtgggcaggc

SEQ ID NO: 809356 - DNA, 20 bp, Artificial
  CRISPR gRNA sequence
ggggttttgtgggcaggctc

SEQ ID NO: 809357 - DNA, 20 bp, Artificial
  CRISPR gRNA sequence
tgtgggcaggctccacccag

SEQ ID NO: 809358 - DNA, 20 bp, Artificial
  CRISPR gRNA sequence
gtgggcaggctccacccagg

SEQ ID NO: 809359 - DNA, 20 bp, Artificial
  CRISPR gRNA sequence
tgggcaggctccacccagga

SEQ ID NO: 809360 - DNA, 20 bp, Artificial
  CRISPR gRNA sequence
cacccaggaaaccaaagaca

SEQ ID NO: 809361 - DNA, 20 bp, Artificial
  CRISPR gRNA sequence
aaaggcttcagcatgctctg

SEQ ID NO: 809362 - DNA, 20 bp, Artificial
  CRISPR gRNA sequence
cagcatgctctgtcccagct

SEQ ID NO: 809363 - DNA, 20 bp, Artificial
  CRISPR gRNA sequence
agcatgctctgtcccagctg

SEQ ID NO: 809364 - DNA, 20 bp, Artificial
  CRISPR gRNA sequence
tgtcccagctggtacaacag

SEQ ID NO: 809365 - DNA, 20 bp, Artificial
  CRISPR gRNA sequence
tcccagctggtacaacagaa

SEQ ID NO: 809366 - DNA, 20 bp, Artificial
  CRISPR gRNA sequence
gtacaacagaacaggagtgt

SEQ ID NO: 809367 - DNA, 20 bp, Artificial
  CRISPR gRNA sequence
gtaagaatacaacaggctaa

SEQ ID NO: 809368 - DNA, 20 bp, Artificial
  CRISPR gRNA sequence
aggagaaactcgaagggagc

SEQ ID NO: 809369 - DNA, 20 bp, Artificial
  CRISPR gRNA sequence
gaagggagctgctgaaagac

SEQ ID NO: 809370 - DNA, 20 bp, Artificial
  CRISPR gRNA sequence
ctgaaagacgttaatgcacc

SEQ ID NO: 809371 - DNA, 20 bp, Artificial
  CRISPR gRNA sequence
aaagacgttaatgcaccacc

SEQ ID NO: 809372 - DNA, 20 bp, Artificial
  CRISPR gRNA sequence
atgcaccaccaaccagctgt

SEQ ID NO: 809373 - DNA, 20 bp, Artificial
  CRISPR gRNA sequence
tttccttatccccaaatggc

SEQ ID NO: 809374 - DNA, 20 bp, Artificial
  CRISPR gRNA sequence
ccttatccccaaatggcctc

SEQ ID NO: 809375 - DNA, 20 bp, Artificial
  CRISPR gRNA sequence
cttatccccaaatggcctca

SEQ ID NO: 809376 - DNA, 20 bp, Artificial
  CRISPR gRNA sequence
atccccaaatggcctcacaa

SEQ ID NO: 809377 - DNA, 20 bp, Artificial
  CRISPR gRNA sequence
tccccaaatggcctcacaaa

SEQ ID NO: 809378 - DNA, 20 bp, Artificial
  CRISPR gRNA sequence
acaaacctttctcctttcct

SEQ ID NO: 809379 - DNA, 20 bp, Artificial
  CRISPR gRNA sequence
tctcctttccttacccaacc

SEQ ID NO: 809380 - DNA, 20 bp, Artificial
  CRISPR gRNA sequence
ctcctttccttacccaaccg

SEQ ID NO: 809381 - DNA, 20 bp, Artificial
  CRISPR gRNA sequence
tcctttccttacccaaccgt

SEQ ID NO: 809382 - DNA, 20 bp, Artificial
  CRISPR gRNA sequence
ctttccttacccaaccgtga

SEQ ID NO: 809383 - DNA, 20 bp, Artificial
  CRISPR gRNA sequence
tccttacccaaccgtgaggt

SEQ ID NO: 809384 - DNA, 20 bp, Artificial
  CRISPR gRNA sequence
ccttacccaaccgtgaggtt

SEQ ID NO: 809385 - DNA, 20 bp, Artificial
  CRISPR gRNA sequence
cttacccaaccgtgaggttg

SEQ ID NO: 809386 - DNA, 20 bp, Artificial
  CRISPR gRNA sequence
acccaaccgtgaggttgaga

SEQ ID NO: 809387 - DNA, 20 bp, Artificial
  CRISPR gRNA sequence
cccaaccgtgaggttgagat

SEQ ID NO: 809388 - DNA, 20 bp, Artificial
  CRISPR gRNA sequence
agattcctgggagagggggt

SEQ ID NO: 809389 - DNA, 20 bp, Artificial
  CRISPR gRNA sequence
ctgggagagggggtgggttt

SEQ ID NO: 809390 - DNA, 20 bp, Artificial
  CRISPR gRNA sequence
ggagagggggtgggtttaac

SEQ ID NO: 809391 - DNA, 20 bp, Artificial
  CRISPR gRNA sequence
aacccaggtcatatccagac

SEQ ID NO: 809392 - DNA, 20 bp, Artificial
  CRISPR gRNA sequence
acccaggtcatatccagact

SEQ ID NO: 809393 - DNA, 20 bp, Artificial
  CRISPR gRNA sequence
gggaaaagaggggtgaaaat

SEQ ID NO: 809394 - DNA, 20 bp, Artificial
  CRISPR gRNA sequence
agaaaggatcctggcaacct

SEQ ID NO: 809395 - DNA, 20 bp, Artificial
  CRISPR gRNA sequence
gcaacctcccaccagcaaaa

SEQ ID NO: 809396 - DNA, 20 bp, Artificial
  CRISPR gRNA sequence
ccaccagcaaaatcggagca

SEQ ID NO: 809397 - DNA, 20 bp, Artificial
  CRISPR gRNA sequence
tctgcattgccaaaataaca

SEQ ID NO: 809398 - DNA, 20 bp, Artificial
  CRISPR gRNA sequence
tgcattgccaaaataacatc

SEQ ID NO: 809399 - DNA, 20 bp, Artificial
  CRISPR gRNA sequence
cattgccaaaataacatcac

SEQ ID NO: 809400 - DNA, 20 bp, Artificial
  CRISPR gRNA sequence
ccaaaataacatcactctca

SEQ ID NO: 809401 - DNA, 20 bp, Artificial
  CRISPR gRNA sequence
tcatgaggctgatgaaagct

SEQ ID NO: 809402 - DNA, 20 bp, Artificial
  CRISPR gRNA sequence
atgaggctgatgaaagctct

SEQ ID NO: 809403 - DNA, 20 bp, Artificial
  CRISPR gRNA sequence
atgaaagctcttggctcaaa

SEQ ID NO: 809404 - DNA, 20 bp, Artificial
  CRISPR gRNA sequence
ttggctcaaagaataagaca

SEQ ID NO: 809405 - DNA, 20 bp, Artificial
  CRISPR gRNA sequence
ggctcaaagaataagacaaa

SEQ ID NO: 809406 - DNA, 20 bp, Artificial
  CRISPR gRNA sequence
gctcaaagaataagacaaac

SEQ ID NO: 809407 - DNA, 20 bp, Artificial
  CRISPR gRNA sequence
aaagaataagacaaactctt

SEQ ID NO: 809408 - DNA, 20 bp, Artificial
  CRISPR gRNA sequence
tttcagacataagaacaaaa

SEQ ID NO: 809409 - DNA, 20 bp, Artificial
  CRISPR gRNA sequence
tcagacataagaacaaaaca

SEQ ID NO: 809410 - DNA, 20 bp, Artificial
  CRISPR gRNA sequence
cagacataagaacaaaacat

SEQ ID NO: 809411 - DNA, 20 bp, Artificial
  CRISPR gRNA sequence
agacataagaacaaaacatt

SEQ ID NO: 809412 - DNA, 20 bp, Artificial
  CRISPR gRNA sequence
cctttaaaaaactcagtgta

SEQ ID NO: 809413 - DNA, 20 bp, Artificial
  CRISPR gRNA sequence
taaaaaactcagtgtaagaa

SEQ ID NO: 809414 - DNA, 20 bp, Artificial
  CRISPR gRNA sequence
aaaaaactcagtgtaagaag

SEQ ID NO: 809415 - DNA, 20 bp, Artificial
  CRISPR gRNA sequence
aaaaactcagtgtaagaagt

SEQ ID NO: 809416 - DNA, 20 bp, Artificial
  CRISPR gRNA sequence
agtgtaagaagttcagctca

SEQ ID NO: 809417 - DNA, 20 bp, Artificial
  CRISPR gRNA sequence
agctcactgacgatgagagc

SEQ ID NO: 809418 - DNA, 20 bp, Artificial
  CRISPR gRNA sequence
actgacgatgagagccattt

SEQ ID NO: 809419 - DNA, 20 bp, Artificial
  CRISPR gRNA sequence
acgatgagagccattttctt

SEQ ID NO: 809420 - DNA, 20 bp, Artificial
  CRISPR gRNA sequence
tcttctggggaaaaataatc

SEQ ID NO: 809421 - DNA, 20 bp, Artificial
  CRISPR gRNA sequence
cttctggggaaaaataatca

SEQ ID NO: 809422 - DNA, 20 bp, Artificial
  CRISPR gRNA sequence
ttctggggaaaaataatcat

SEQ ID NO: 809423 - DNA, 20 bp, Artificial
  CRISPR gRNA sequence
ctggggaaaaataatcatca

SEQ ID NO: 809424 - DNA, 20 bp, Artificial
  CRISPR gRNA sequence
tggggaaaaataatcatcaa

SEQ ID NO: 809425 - DNA, 20 bp, Artificial
  CRISPR gRNA sequence
gggaaaaataatcatcaaga

SEQ ID NO: 809426 - DNA, 20 bp, Artificial
  CRISPR gRNA sequence
aaagtggttcataagctctg

SEQ ID NO: 809427 - DNA, 20 bp, Artificial
  CRISPR gRNA sequence
ataagctctgagtgggttta

SEQ ID NO: 809428 - DNA, 20 bp, Artificial
  CRISPR gRNA sequence
tgagtgggtttagcatgaaa

SEQ ID NO: 809429 - DNA, 20 bp, Artificial
  CRISPR gRNA sequence
agtgggtttagcatgaaagc

SEQ ID NO: 809430 - DNA, 20 bp, Artificial
  CRISPR gRNA sequence
agcatgaaagcagcaagcca

SEQ ID NO: 809431 - DNA, 20 bp, Artificial
  CRISPR gRNA sequence
gcatgaaagcagcaagccat

SEQ ID NO: 809432 - DNA, 20 bp, Artificial
  CRISPR gRNA sequence
cagtgcaaagcagtggctca

SEQ ID NO: 809433 - DNA, 20 bp, Artificial
  CRISPR gRNA sequence
atgctgcagacacccagtgc

SEQ ID NO: 809434 - DNA, 20 bp, Artificial
  CRISPR gRNA sequence
cagacacccagtgcattggg

SEQ ID NO: 809435 - DNA, 20 bp, Artificial
  CRISPR gRNA sequence
ggttaccatgaataaaactc

SEQ ID NO: 809436 - DNA, 20 bp, Artificial
  CRISPR gRNA sequence
ccatgaataaaactcactta

SEQ ID NO: 809437 - DNA, 20 bp, Artificial
  CRISPR gRNA sequence
acttaccttttgaagaatac

SEQ ID NO: 809438 - DNA, 20 bp, Artificial
  CRISPR gRNA sequence
accttttgaagaatacagct

SEQ ID NO: 809439 - DNA, 20 bp, Artificial
  CRISPR gRNA sequence
ccttttgaagaatacagctt

SEQ ID NO: 809440 - DNA, 20 bp, Artificial
  CRISPR gRNA sequence
ttgaagaatacagcttttga

SEQ ID NO: 809441 - DNA, 20 bp, Artificial
  CRISPR gRNA sequence
tgaagaatacagcttttgac

SEQ ID NO: 809442 - DNA, 20 bp, Artificial
  CRISPR gRNA sequence
gaagaatacagcttttgaca

SEQ ID NO: 809443 - DNA, 20 bp, Artificial
  CRISPR gRNA sequence
aagaatacagcttttgacag

SEQ ID NO: 809444 - DNA, 20 bp, Artificial
  CRISPR gRNA sequence
ttgacagagttgttttctta

SEQ ID NO: 809445 - DNA, 20 bp, Artificial
  CRISPR gRNA sequence
tgacagagttgttttcttag

SEQ ID NO: 809446 - DNA, 20 bp, Artificial
  CRISPR gRNA sequence
gacagagttgttttcttagg

SEQ ID NO: 809447 - DNA, 20 bp, Artificial
  CRISPR gRNA sequence
acagagttgttttcttaggg

SEQ ID NO: 809448 - DNA, 20 bp, Artificial
  CRISPR gRNA sequence
ttttcttagggctatcactg

SEQ ID NO: 809449 - DNA, 20 bp, Artificial
  CRISPR gRNA sequence
tcttagggctatcactgtgg

SEQ ID NO: 809450 - DNA, 20 bp, Artificial
  CRISPR gRNA sequence
cttagggctatcactgtggc

SEQ ID NO: 809451 - DNA, 20 bp, Artificial
  CRISPR gRNA sequence
ttagggctatcactgtggct

SEQ ID NO: 809452 - DNA, 20 bp, Artificial
  CRISPR gRNA sequence
agggctatcactgtggctat

SEQ ID NO: 809453 - DNA, 20 bp, Artificial
  CRISPR gRNA sequence
gggctatcactgtggctatg

SEQ ID NO: 809454 - DNA, 20 bp, Artificial
  CRISPR gRNA sequence
tcactgtggctatgaaaatg

SEQ ID NO: 809455 - DNA, 20 bp, Artificial
  CRISPR gRNA sequence
tggctatgaaaatgaaagca

SEQ ID NO: 809456 - DNA, 20 bp, Artificial
  CRISPR gRNA sequence
tgaaaatgaaagcaatgatg

SEQ ID NO: 809457 - DNA, 20 bp, Artificial
  CRISPR gRNA sequence
gatgggtcctgggttccatc

SEQ ID NO: 809458 - DNA, 20 bp, Artificial
  CRISPR gRNA sequence
ggttccatctgacctgggca

SEQ ID NO: 809459 - DNA, 20 bp, Artificial
  CRISPR gRNA sequence
catctgacctgggcaaagga

SEQ ID NO: 809460 - DNA, 20 bp, Artificial
  CRISPR gRNA sequence
acctgggcaaaggaaaagca

SEQ ID NO: 809461 - DNA, 20 bp, Artificial
  CRISPR gRNA sequence
ggcaaaggaaaagcaccaga

SEQ ID NO: 809462 - DNA, 20 bp, Artificial
  CRISPR gRNA sequence
ttacatggcaactaagaggt

SEQ ID NO: 809463 - DNA, 20 bp, Artificial
  CRISPR gRNA sequence
catggcaactaagaggtaga

SEQ ID NO: 809464 - DNA, 20 bp, Artificial
  CRISPR gRNA sequence
agaggtagaccaacaggctg

SEQ ID NO: 809465 - DNA, 20 bp, Artificial
  CRISPR gRNA sequence
gccacatgagtgggtgacag

SEQ ID NO: 809466 - DNA, 20 bp, Artificial
  CRISPR gRNA sequence
gctctgtggagcatttactc

SEQ ID NO: 809467 - DNA, 20 bp, Artificial
  CRISPR gRNA sequence
tgtggagcatttactccaca

SEQ ID NO: 809468 - DNA, 20 bp, Artificial
  CRISPR gRNA sequence
tggagcatttactccacacc

SEQ ID NO: 809469 - DNA, 20 bp, Artificial
  CRISPR gRNA sequence
actccacaccaggccctatt

SEQ ID NO: 809470 - DNA, 20 bp, Artificial
  CRISPR gRNA sequence
ctccacaccaggccctattc

SEQ ID NO: 809471 - DNA, 20 bp, Artificial
  CRISPR gRNA sequence
cacaccaggccctattctaa

SEQ ID NO: 809472 - DNA, 20 bp, Artificial
  CRISPR gRNA sequence
ttctaagtgctctgcaccta

SEQ ID NO: 809473 - DNA, 20 bp, Artificial
  CRISPR gRNA sequence
taagtgctctgcacctatca

SEQ ID NO: 809474 - DNA, 20 bp, Artificial
  CRISPR gRNA sequence
agtgctctgcacctatcagc

SEQ ID NO: 809475 - DNA, 20 bp, Artificial
  CRISPR gRNA sequence
tgcacctatcagctcatcca

SEQ ID NO: 809476 - DNA, 20 bp, Artificial
  CRISPR gRNA sequence
cacctatcagctcatccact

SEQ ID NO: 809477 - DNA, 20 bp, Artificial
  CRISPR gRNA sequence
tcagctcatccactcctcgc

SEQ ID NO: 809478 - DNA, 20 bp, Artificial
  CRISPR gRNA sequence
atccactcctcgcaaccact

SEQ ID NO: 809479 - DNA, 20 bp, Artificial
  CRISPR gRNA sequence
ctcgcaaccactctgtgaag

SEQ ID NO: 809480 - DNA, 20 bp, Artificial
  CRISPR gRNA sequence
gcaaccactctgtgaagttg

SEQ ID NO: 809481 - DNA, 20 bp, Artificial
  CRISPR gRNA sequence
tgtgaagttggctctgctat

SEQ ID NO: 809482 - DNA, 20 bp, Artificial
  CRISPR gRNA sequence
tgaagttggctctgctatga

SEQ ID NO: 809483 - DNA, 20 bp, Artificial
  CRISPR gRNA sequence
gctctgctatgatccccatt

SEQ ID NO: 809484 - DNA, 20 bp, Artificial
  CRISPR gRNA sequence
tgctatgatccccatttcac

SEQ ID NO: 809485 - DNA, 20 bp, Artificial
  CRISPR gRNA sequence
ctatgatccccatttcactg

SEQ ID NO: 809486 - DNA, 20 bp, Artificial
  CRISPR gRNA sequence
tgatccccatttcactggtg

SEQ ID NO: 809487 - DNA, 20 bp, Artificial
  CRISPR gRNA sequence
cactggtgaagaaagggagg

SEQ ID NO: 809488 - DNA, 20 bp, Artificial
  CRISPR gRNA sequence
actggtgaagaaagggaggc

SEQ ID NO: 809489 - DNA, 20 bp, Artificial
  CRISPR gRNA sequence
gtgaagaaagggaggcacag

SEQ ID NO: 809490 - DNA, 20 bp, Artificial
  CRISPR gRNA sequence
ggaagctttccctaagttac

SEQ ID NO: 809491 - DNA, 20 bp, Artificial
  CRISPR gRNA sequence
tccctaagttacatagtaag

SEQ ID NO: 809492 - DNA, 20 bp, Artificial
  CRISPR gRNA sequence
ccctaagttacatagtaagt

SEQ ID NO: 809493 - DNA, 20 bp, Artificial
  CRISPR gRNA sequence
cctaagttacatagtaagtg

SEQ ID NO: 809494 - DNA, 20 bp, Artificial
  CRISPR gRNA sequence
agttacatagtaagtgaccc

SEQ ID NO: 809495 - DNA, 20 bp, Artificial
  CRISPR gRNA sequence
catagtaagtgacccagcta

SEQ ID NO: 809496 - DNA, 20 bp, Artificial
  CRISPR gRNA sequence
agatacagtctggttccaga

SEQ ID NO: 809497 - DNA, 20 bp, Artificial
  CRISPR gRNA sequence
gttccagattctgtgctttt

SEQ ID NO: 809498 - DNA, 20 bp, Artificial
  CRISPR gRNA sequence
cagattctgtgctttttacc

SEQ ID NO: 809499 - DNA, 20 bp, Artificial
  CRISPR gRNA sequence
tgtgctttttaccactctct

SEQ ID NO: 809500 - DNA, 20 bp, Artificial
  CRISPR gRNA sequence
tgctttttaccactctctca

SEQ ID NO: 809501 - DNA, 20 bp, Artificial
  CRISPR gRNA sequence
tttaccactctctcatgtta

SEQ ID NO: 809502 - DNA, 20 bp, Artificial
  CRISPR gRNA sequence
ttaccactctctcatgttat

SEQ ID NO: 809503 - DNA, 20 bp, Artificial
  CRISPR gRNA sequence
taccactctctcatgttatt

SEQ ID NO: 809504 - DNA, 20 bp, Artificial
  CRISPR gRNA sequence
accactctctcatgttattt

SEQ ID NO: 809505 - DNA, 20 bp, Artificial
  CRISPR gRNA sequence
ccactctctcatgttatttt

SEQ ID NO: 809506 - DNA, 20 bp, Artificial
  CRISPR gRNA sequence
tctcatgttatttttttcca

SEQ ID NO: 809507 - DNA, 20 bp, Artificial
  CRISPR gRNA sequence
tcatgttatttttttccatc

SEQ ID NO: 809508 - DNA, 20 bp, Artificial
  CRISPR gRNA sequence
atgttatttttttccatcca

SEQ ID NO: 809509 - DNA, 20 bp, Artificial
  CRISPR gRNA sequence
tttttttccatccatccatc

SEQ ID NO: 809510 - DNA, 20 bp, Artificial
  CRISPR gRNA sequence
ttttccatccatccatcaat

SEQ ID NO: 809511 - DNA, 20 bp, Artificial
  CRISPR gRNA sequence
tttccatccatccatcaatc

SEQ ID NO: 809512 - DNA, 20 bp, Artificial
  CRISPR gRNA sequence
ttccatccatccatcaatcc

SEQ ID NO: 809513 - DNA, 20 bp, Artificial
  CRISPR gRNA sequence
tccatccatccatcaatcca

SEQ ID NO: 809514 - DNA, 20 bp, Artificial
  CRISPR gRNA sequence
ccatccatccatcaatccat

SEQ ID NO: 809515 - DNA, 20 bp, Artificial
  CRISPR gRNA sequence
catccatccatcaatccatc

SEQ ID NO: 809516 - DNA, 20 bp, Artificial
  CRISPR gRNA sequence
tcatctaatcatctttcttt

SEQ ID NO: 809517 - DNA, 20 bp, Artificial
  CRISPR gRNA sequence
atcatctttctttctttttt

SEQ ID NO: 809518 - DNA, 20 bp, Artificial
  CRISPR gRNA sequence
tctttcttttttctcttttt

SEQ ID NO: 809519 - DNA, 20 bp, Artificial
  CRISPR gRNA sequence
ctttcttttttctctttttc

SEQ ID NO: 809520 - DNA, 20 bp, Artificial
  CRISPR gRNA sequence
tttcttttttctctttttcc

SEQ ID NO: 809521 - DNA, 20 bp, Artificial
  CRISPR gRNA sequence
tcttttttctctttttcctc

SEQ ID NO: 809522 - DNA, 20 bp, Artificial
  CRISPR gRNA sequence
cttttttctctttttcctcc

SEQ ID NO: 809523 - DNA, 20 bp, Artificial
  CRISPR gRNA sequence
ttttttctctttttcctccc

SEQ ID NO: 809524 - DNA, 20 bp, Artificial
  CRISPR gRNA sequence
ttttctctttttcctcccta

SEQ ID NO: 809525 - DNA, 20 bp, Artificial
  CRISPR gRNA sequence
tttctctttttcctccctat

SEQ ID NO: 809526 - DNA, 20 bp, Artificial
  CRISPR gRNA sequence
ttctctttttcctccctatc

SEQ ID NO: 809527 - DNA, 20 bp, Artificial
  CRISPR gRNA sequence
tctctttttcctccctatcc

SEQ ID NO: 809528 - DNA, 20 bp, Artificial
  CRISPR gRNA sequence
ctctttttcctccctatccc

SEQ ID NO: 809529 - DNA, 20 bp, Artificial
  CRISPR gRNA sequence
tctttttcctccctatcccc

SEQ ID NO: 809530 - DNA, 20 bp, Artificial
  CRISPR gRNA sequence
tttttcctccctatccccct

SEQ ID NO: 809531 - DNA, 20 bp, Artificial
  CRISPR gRNA sequence
tttcctccctatcccccttc

SEQ ID NO: 809532 - DNA, 20 bp, Artificial
  CRISPR gRNA sequence
ttcctccctatcccccttct

SEQ ID NO: 809533 - DNA, 20 bp, Artificial
  CRISPR gRNA sequence
tcctccctatcccccttctc

SEQ ID NO: 809534 - DNA, 20 bp, Artificial
  CRISPR gRNA sequence
cctccctatcccccttctcc

SEQ ID NO: 809535 - DNA, 20 bp, Artificial
  CRISPR gRNA sequence
ctccctatcccccttctcct

SEQ ID NO: 809536 - DNA, 20 bp, Artificial
  CRISPR gRNA sequence
cctatcccccttctcctcct

SEQ ID NO: 809537 - DNA, 20 bp, Artificial
  CRISPR gRNA sequence
tcccccttctcctcctcatc

SEQ ID NO: 809538 - DNA, 20 bp, Artificial
  CRISPR gRNA sequence
ctcctcctcatcctctctct

SEQ ID NO: 809539 - DNA, 20 bp, Artificial
  CRISPR gRNA sequence
tcctcctcatcctctctctc

SEQ ID NO: 809540 - DNA, 20 bp, Artificial
  CRISPR gRNA sequence
ctcctcatcctctctctctt

SEQ ID NO: 809541 - DNA, 20 bp, Artificial
  CRISPR gRNA sequence
ctcatcctctctctcttccc

SEQ ID NO: 809542 - DNA, 20 bp, Artificial
  CRISPR gRNA sequence
atcctctctctcttcccagt

SEQ ID NO: 809543 - DNA, 20 bp, Artificial
  CRISPR gRNA sequence
tctctcttcccagtggcaaa

SEQ ID NO: 809544 - DNA, 20 bp, Artificial
  CRISPR gRNA sequence
tctcttcccagtggcaaagt

SEQ ID NO: 809545 - DNA, 20 bp, Artificial
  CRISPR gRNA sequence
tcttcccagtggcaaagtct

SEQ ID NO: 809546 - DNA, 20 bp, Artificial
  CRISPR gRNA sequence
ttcccagtggcaaagtctct

SEQ ID NO: 809547 - DNA, 20 bp, Artificial
  CRISPR gRNA sequence
cccagtggcaaagtctctca

SEQ ID NO: 809548 - DNA, 20 bp, Artificial
  CRISPR gRNA sequence
ccagtggcaaagtctctcag

SEQ ID NO: 809549 - DNA, 20 bp, Artificial
  CRISPR gRNA sequence
tcagcccaaaaatgtctttc

SEQ ID NO: 809550 - DNA, 20 bp, Artificial
  CRISPR gRNA sequence
agcccaaaaatgtctttccc

SEQ ID NO: 809551 - DNA, 20 bp, Artificial
  CRISPR gRNA sequence
tcccccactgacaagtactc

SEQ ID NO: 809552 - DNA, 20 bp, Artificial
  CRISPR gRNA sequence
cccccactgacaagtactca

SEQ ID NO: 809553 - DNA, 20 bp, Artificial
  CRISPR gRNA sequence
ccccactgacaagtactcac

SEQ ID NO: 809554 - DNA, 20 bp, Artificial
  CRISPR gRNA sequence
acaagtactcacagtgctta

SEQ ID NO: 809555 - DNA, 20 bp, Artificial
  CRISPR gRNA sequence
acagtgcttagaatctatac

SEQ ID NO: 809556 - DNA, 20 bp, Artificial
  CRISPR gRNA sequence
agaatctataccattagttg

SEQ ID NO: 809557 - DNA, 20 bp, Artificial
  CRISPR gRNA sequence
gaatctataccattagttgt

SEQ ID NO: 809558 - DNA, 20 bp, Artificial
  CRISPR gRNA sequence
taccattagttgttaaattt

SEQ ID NO: 809559 - DNA, 20 bp, Artificial
  CRISPR gRNA sequence
gttgttaaatttcaaggatt

SEQ ID NO: 809560 - DNA, 20 bp, Artificial
  CRISPR gRNA sequence
ttaaatttcaaggattaaca

SEQ ID NO: 809561 - DNA, 20 bp, Artificial
  CRISPR gRNA sequence
aatttcaaggattaacagga

SEQ ID NO: 809562 - DNA, 20 bp, Artificial
  CRISPR gRNA sequence
caaggattaacaggatcctt

SEQ ID NO: 809563 - DNA, 20 bp, Artificial
  CRISPR gRNA sequence
aaggattaacaggatccttt

SEQ ID NO: 809564 - DNA, 20 bp, Artificial
  CRISPR gRNA sequence
acaggatccttttggaagaa

SEQ ID NO: 809565 - DNA, 20 bp, Artificial
  CRISPR gRNA sequence
ttggaagaaatagaatatcc

SEQ ID NO: 809566 - DNA, 20 bp, Artificial
  CRISPR gRNA sequence
tggaagaaatagaatatcct

SEQ ID NO: 809567 - DNA, 20 bp, Artificial
  CRISPR gRNA sequence
ggaagaaatagaatatccta

SEQ ID NO: 809568 - DNA, 20 bp, Artificial
  CRISPR gRNA sequence
gaagaaatagaatatcctag

SEQ ID NO: 809569 - DNA, 20 bp, Artificial
  CRISPR gRNA sequence
ggtagtgttaatatactaaa

SEQ ID NO: 809570 - DNA, 20 bp, Artificial
  CRISPR gRNA sequence
atatactaaacctagtcact

SEQ ID NO: 809571 - DNA, 20 bp, Artificial
  CRISPR gRNA sequence
aacctagtcactcatgcctt

SEQ ID NO: 809572 - DNA, 20 bp, Artificial
  CRISPR gRNA sequence
gtcactcatgccttagtgtg

SEQ ID NO: 809573 - DNA, 20 bp, Artificial
  CRISPR gRNA sequence
atgccttagtgtgaattatt

SEQ ID NO: 809574 - DNA, 20 bp, Artificial
  CRISPR gRNA sequence
agtgtgaattattacaattg

SEQ ID NO: 809575 - DNA, 20 bp, Artificial
  CRISPR gRNA sequence
gtgtgaattattacaattgg

SEQ ID NO: 809576 - DNA, 20 bp, Artificial
  CRISPR gRNA sequence
ttacaattggccctttgcct

SEQ ID NO: 809577 - DNA, 20 bp, Artificial
  CRISPR gRNA sequence
caattggccctttgccttgt

SEQ ID NO: 809578 - DNA, 20 bp, Artificial
  CRISPR gRNA sequence
gccctttgccttgtttcggt

SEQ ID NO: 809579 - DNA, 20 bp, Artificial
  CRISPR gRNA sequence
tgccttgtttcggtttttca

SEQ ID NO: 809580 - DNA, 20 bp, Artificial
  CRISPR gRNA sequence
gccttgtttcggtttttcaa

SEQ ID NO: 809581 - DNA, 20 bp, Artificial
  CRISPR gRNA sequence
ccttgtttcggtttttcaac

SEQ ID NO: 809582 - DNA, 20 bp, Artificial
  CRISPR gRNA sequence
gtttcggtttttcaacgtcc

SEQ ID NO: 809583 - DNA, 20 bp, Artificial
  CRISPR gRNA sequence
tttcggtttttcaacgtcct

SEQ ID NO: 809584 - DNA, 20 bp, Artificial
  CRISPR gRNA sequence
cggtttttcaacgtcctagc

SEQ ID NO: 809585 - DNA, 20 bp, Artificial
  CRISPR gRNA sequence
ggtttttcaacgtcctagca

SEQ ID NO: 809586 - DNA, 20 bp, Artificial
  CRISPR gRNA sequence
ttcaacgtcctagcactgag

SEQ ID NO: 809587 - DNA, 20 bp, Artificial
  CRISPR gRNA sequence
tcaacgtcctagcactgagg

SEQ ID NO: 809588 - DNA, 20 bp, Artificial
  CRISPR gRNA sequence
caacgtcctagcactgagga

SEQ ID NO: 809589 - DNA, 20 bp, Artificial
  CRISPR gRNA sequence
aacgtcctagcactgaggaa

SEQ ID NO: 809590 - DNA, 20 bp, Artificial
  CRISPR gRNA sequence
gcactgaggaaagggtgagt

SEQ ID NO: 809591 - DNA, 20 bp, Artificial
  CRISPR gRNA sequence
aggaaagggtgagtttagta

SEQ ID NO: 809592 - DNA, 20 bp, Artificial
  CRISPR gRNA sequence
agtagagggtggatcagaag

SEQ ID NO: 809593 - DNA, 20 bp, Artificial
  CRISPR gRNA sequence
gtagagggtggatcagaaga

SEQ ID NO: 809594 - DNA, 20 bp, Artificial
  CRISPR gRNA sequence
tggaggctggggaaagcctt

SEQ ID NO: 809595 - DNA, 20 bp, Artificial
  CRISPR gRNA sequence
gaggctggggaaagccttgt

SEQ ID NO: 809596 - DNA, 20 bp, Artificial
  CRISPR gRNA sequence
gggaaagccttgtaaagtcc

SEQ ID NO: 809597 - DNA, 20 bp, Artificial
  CRISPR gRNA sequence
gtaaagtcctctggtgtgta

SEQ ID NO: 809598 - DNA, 20 bp, Artificial
  CRISPR gRNA sequence
taaagtcctctggtgtgtac

SEQ ID NO: 809599 - DNA, 20 bp, Artificial
  CRISPR gRNA sequence
tggtgtgtacagattagaac

SEQ ID NO: 809600 - DNA, 20 bp, Artificial
  CRISPR gRNA sequence
gtgtgtacagattagaacaa

SEQ ID NO: 809601 - DNA, 20 bp, Artificial
  CRISPR gRNA sequence
gaacaagggctccagactga

SEQ ID NO: 809602 - DNA, 20 bp, Artificial
  CRISPR gRNA sequence
cagactgacaaaaggcaggg

SEQ ID NO: 809603 - DNA, 20 bp, Artificial
  CRISPR gRNA sequence
acaaaaggcagggctagagg

SEQ ID NO: 809604 - DNA, 20 bp, Artificial
  CRISPR gRNA sequence
gaggagtgttcacctacagg

SEQ ID NO: 809605 - DNA, 20 bp, Artificial
  CRISPR gRNA sequence
acctacagggaaatgaaagg

SEQ ID NO: 809606 - DNA, 20 bp, Artificial
  CRISPR gRNA sequence
cagggaaatgaaagggtact

SEQ ID NO: 809607 - DNA, 20 bp, Artificial
  CRISPR gRNA sequence
aagttaatttgtgccctatt

SEQ ID NO: 809608 - DNA, 20 bp, Artificial
  CRISPR gRNA sequence
atttgtgccctattcaaaag

SEQ ID NO: 809609 - DNA, 20 bp, Artificial
  CRISPR gRNA sequence
gtgccctattcaaaagcttg

SEQ ID NO: 809610 - DNA, 20 bp, Artificial
  CRISPR gRNA sequence
tgccctattcaaaagcttga

SEQ ID NO: 809611 - DNA, 20 bp, Artificial
  CRISPR gRNA sequence
ttcaaaagcttgaattttgc

SEQ ID NO: 809612 - DNA, 20 bp, Artificial
  CRISPR gRNA sequence
aaaagcttgaattttgcctc

SEQ ID NO: 809613 - DNA, 20 bp, Artificial
  CRISPR gRNA sequence
gaattttgcctctggagtca

SEQ ID NO: 809614 - DNA, 20 bp, Artificial
  CRISPR gRNA sequence
aattttgcctctggagtcat

SEQ ID NO: 809615 - DNA, 20 bp, Artificial
  CRISPR gRNA sequence
tgcctctggagtcattcaca

SEQ ID NO: 809616 - DNA, 20 bp, Artificial
  CRISPR gRNA sequence
gcctctggagtcattcacat

SEQ ID NO: 809617 - DNA, 20 bp, Artificial
  CRISPR gRNA sequence
cctctggagtcattcacatg

SEQ ID NO: 809618 - DNA, 20 bp, Artificial
  CRISPR gRNA sequence
tggagtcattcacatggaat

SEQ ID NO: 809619 - DNA, 20 bp, Artificial
  CRISPR gRNA sequence
gagtcattcacatggaataa

SEQ ID NO: 809620 - DNA, 20 bp, Artificial
  CRISPR gRNA sequence
acatggaataaacatgacag

SEQ ID NO: 809621 - DNA, 20 bp, Artificial
  CRISPR gRNA sequence
gtacaggaaaaactggacga

SEQ ID NO: 809622 - DNA, 20 bp, Artificial
  CRISPR gRNA sequence
gacgaaactgctcagcggga

SEQ ID NO: 809623 - DNA, 20 bp, Artificial
  CRISPR gRNA sequence
ctcagcgggaagggctcagt

SEQ ID NO: 809624 - DNA, 20 bp, Artificial
  CRISPR gRNA sequence
agcgggaagggctcagtcct

SEQ ID NO: 809625 - DNA, 20 bp, Artificial
  CRISPR gRNA sequence
agtcctcccaacttcccagc

SEQ ID NO: 809626 - DNA, 20 bp, Artificial
  CRISPR gRNA sequence
ccaacttcccagccctcaaa

SEQ ID NO: 809627 - DNA, 20 bp, Artificial
  CRISPR gRNA sequence
cccagccctcaaaccccact

SEQ ID NO: 809628 - DNA, 20 bp, Artificial
  CRISPR gRNA sequence
ccagccctcaaaccccacta

SEQ ID NO: 809629 - DNA, 20 bp, Artificial
  CRISPR gRNA sequence
aaaccccactacctccagca

SEQ ID NO: 809630 - DNA, 20 bp, Artificial
  CRISPR gRNA sequence
cctccagcacagtgctatct

SEQ ID NO: 809631 - DNA, 20 bp, Artificial
  CRISPR gRNA sequence
cagcacagtgctatctgaga

SEQ ID NO: 809632 - DNA, 20 bp, Artificial
  CRISPR gRNA sequence
tctgagaaccacggattgtt

SEQ ID NO: 809633 - DNA, 20 bp, Artificial
  CRISPR gRNA sequence
agaaccacggattgttttac

SEQ ID NO: 809634 - DNA, 20 bp, Artificial
  CRISPR gRNA sequence
ttttactggagaagagatta

SEQ ID NO: 809635 - DNA, 20 bp, Artificial
  CRISPR gRNA sequence
tactggagaagagattagac

SEQ ID NO: 809636 - DNA, 20 bp, Artificial
  CRISPR gRNA sequence
actggagaagagattagaca

SEQ ID NO: 809637 - DNA, 20 bp, Artificial
  CRISPR gRNA sequence
ctggagaagagattagacat

SEQ ID NO: 809638 - DNA, 20 bp, Artificial
  CRISPR gRNA sequence
gagaagagattagacattat

SEQ ID NO: 809639 - DNA, 20 bp, Artificial
  CRISPR gRNA sequence
gacattatttagtctgagcc

SEQ ID NO: 809640 - DNA, 20 bp, Artificial
  CRISPR gRNA sequence
tttagtctgagcccctcatt

SEQ ID NO: 809641 - DNA, 20 bp, Artificial
  CRISPR gRNA sequence
agtctgagcccctcatttta

SEQ ID NO: 809642 - DNA, 20 bp, Artificial
  CRISPR gRNA sequence
gtctgagcccctcattttag

SEQ ID NO: 809643 - DNA, 20 bp, Artificial
  CRISPR gRNA sequence
agcccctcattttagagttg

SEQ ID NO: 809644 - DNA, 20 bp, Artificial
  CRISPR gRNA sequence
attttagagttgaggaagta

SEQ ID NO: 809645 - DNA, 20 bp, Artificial
  CRISPR gRNA sequence
tagagttgaggaagtaagtc

SEQ ID NO: 809646 - DNA, 20 bp, Artificial
  CRISPR gRNA sequence
agagttgaggaagtaagtct

SEQ ID NO: 809647 - DNA, 20 bp, Artificial
  CRISPR gRNA sequence
gagttgaggaagtaagtctc

SEQ ID NO: 809648 - DNA, 20 bp, Artificial
  CRISPR gRNA sequence
aggaagtaagtctcagagtt

SEQ ID NO: 809649 - DNA, 20 bp, Artificial
  CRISPR gRNA sequence
agagttgctaaataatctat

SEQ ID NO: 809650 - DNA, 20 bp, Artificial
  CRISPR gRNA sequence
ctaaataatctatgtgaggt

SEQ ID NO: 809651 - DNA, 20 bp, Artificial
  CRISPR gRNA sequence
aataatctatgtgaggtcat

SEQ ID NO: 809652 - DNA, 20 bp, Artificial
  CRISPR gRNA sequence
tgtgaggtcatcactgctaa

SEQ ID NO: 809653 - DNA, 20 bp, Artificial
  CRISPR gRNA sequence
ctaagtaaaagtcaatgcca

SEQ ID NO: 809654 - DNA, 20 bp, Artificial
  CRISPR gRNA sequence
agtaaaagtcaatgccagga

SEQ ID NO: 809655 - DNA, 20 bp, Artificial
  CRISPR gRNA sequence
caaacccagatctatctgac

SEQ ID NO: 809656 - DNA, 20 bp, Artificial
  CRISPR gRNA sequence
tctgacccaaagctcagccc

SEQ ID NO: 809657 - DNA, 20 bp, Artificial
  CRISPR gRNA sequence
acccaaagctcagcccccac

SEQ ID NO: 809658 - DNA, 20 bp, Artificial
  CRISPR gRNA sequence
agcccccacagatatttgtc

SEQ ID NO: 809659 - DNA, 20 bp, Artificial
  CRISPR gRNA sequence
gtctccatccaaaagagtgt

SEQ ID NO: 809660 - DNA, 20 bp, Artificial
  CRISPR gRNA sequence
tctccatccaaaagagtgtg

SEQ ID NO: 809661 - DNA, 20 bp, Artificial
  CRISPR gRNA sequence
catccaaaagagtgtgatta

SEQ ID NO: 809662 - DNA, 20 bp, Artificial
  CRISPR gRNA sequence
acattaacgaagaaaagata

SEQ ID NO: 809663 - DNA, 20 bp, Artificial
  CRISPR gRNA sequence
acgaagaaaagataaggagc

SEQ ID NO: 809664 - DNA, 20 bp, Artificial
  CRISPR gRNA sequence
gctcatccaaacattggata

SEQ ID NO: 809665 - DNA, 20 bp, Artificial
  CRISPR gRNA sequence
ctcatccaaacattggataa

SEQ ID NO: 809666 - DNA, 20 bp, Artificial
  CRISPR gRNA sequence
atccaaacattggataaccc

SEQ ID NO: 809667 - DNA, 20 bp, Artificial
  CRISPR gRNA sequence
gataacccatattgattata

SEQ ID NO: 809668 - DNA, 20 bp, Artificial
  CRISPR gRNA sequence
attataatctgcttcttaat

SEQ ID NO: 809669 - DNA, 20 bp, Artificial
  CRISPR gRNA sequence
taatctgcttcttaatttct

SEQ ID NO: 809670 - DNA, 20 bp, Artificial
  CRISPR gRNA sequence
cttcttaatttctagtaagt

SEQ ID NO: 809671 - DNA, 20 bp, Artificial
  CRISPR gRNA sequence
cttaatttctagtaagtgct

SEQ ID NO: 809672 - DNA, 20 bp, Artificial
  CRISPR gRNA sequence
ttaatttctagtaagtgctt

SEQ ID NO: 809673 - DNA, 20 bp, Artificial
  CRISPR gRNA sequence
aatttctagtaagtgcttag

SEQ ID NO: 809674 - DNA, 20 bp, Artificial
  CRISPR gRNA sequence
atttctagtaagtgcttagt

SEQ ID NO: 809675 - DNA, 20 bp, Artificial
  CRISPR gRNA sequence
ctagtaagtgcttagtaagc

SEQ ID NO: 809676 - DNA, 20 bp, Artificial
  CRISPR gRNA sequence
tagtaagtgcttagtaagca

SEQ ID NO: 809677 - DNA, 20 bp, Artificial
  CRISPR gRNA sequence
gtaagtgcttagtaagcact

SEQ ID NO: 809678 - DNA, 20 bp, Artificial
  CRISPR gRNA sequence
agtaagcactttgtgagtca

SEQ ID NO: 809679 - DNA, 20 bp, Artificial
  CRISPR gRNA sequence
gtaagcactttgtgagtcaa

SEQ ID NO: 809680 - DNA, 20 bp, Artificial
  CRISPR gRNA sequence
tgtgagtcaaggagacctgg

SEQ ID NO: 809681 - DNA, 20 bp, Artificial
  CRISPR gRNA sequence
gtgagtcaaggagacctggg

SEQ ID NO: 809682 - DNA, 20 bp, Artificial
  CRISPR gRNA sequence
tgagtcaaggagacctgggc

SEQ ID NO: 809683 - DNA, 20 bp, Artificial
  CRISPR gRNA sequence
ggcctctcactgtccccaca

SEQ ID NO: 809684 - DNA, 20 bp, Artificial
  CRISPR gRNA sequence
tcactgtccccacaacagga

SEQ ID NO: 809685 - DNA, 20 bp, Artificial
  CRISPR gRNA sequence
actgtccccacaacaggaga

SEQ ID NO: 809686 - DNA, 20 bp, Artificial
  CRISPR gRNA sequence
tccccacaacaggagaggtc

SEQ ID NO: 809687 - DNA, 20 bp, Artificial
  CRISPR gRNA sequence
cctcagtgtctttatgcaaa

SEQ ID NO: 809688 - DNA, 20 bp, Artificial
  CRISPR gRNA sequence
agtgtctttatgcaaaccct

SEQ ID NO: 809689 - DNA, 20 bp, Artificial
  CRISPR gRNA sequence
tatgcaaacccttgtcctgt

SEQ ID NO: 809690 - DNA, 20 bp, Artificial
  CRISPR gRNA sequence
atgcaaacccttgtcctgtg

SEQ ID NO: 809691 - DNA, 20 bp, Artificial
  CRISPR gRNA sequence
tgcaaacccttgtcctgtgc

SEQ ID NO: 809692 - DNA, 20 bp, Artificial
  CRISPR gRNA sequence
gtcctgtgcaggttccctca

SEQ ID NO: 809693 - DNA, 20 bp, Artificial
  CRISPR gRNA sequence
tcctgtgcaggttccctcat

SEQ ID NO: 809694 - DNA, 20 bp, Artificial
  CRISPR gRNA sequence
tgcaggttccctcatagtct

SEQ ID NO: 809695 - DNA, 20 bp, Artificial
  CRISPR gRNA sequence
cctcatagtctcttccacgt

SEQ ID NO: 809696 - DNA, 20 bp, Artificial
  CRISPR gRNA sequence
atagtctcttccacgtacag

SEQ ID NO: 809697 - DNA, 20 bp, Artificial
  CRISPR gRNA sequence
ttccacgtacagaagcccta

SEQ ID NO: 809698 - DNA, 20 bp, Artificial
  CRISPR gRNA sequence
ccacgtacagaagccctact

SEQ ID NO: 809699 - DNA, 20 bp, Artificial
  CRISPR gRNA sequence
cacgtacagaagccctactc

SEQ ID NO: 809700 - DNA, 20 bp, Artificial
  CRISPR gRNA sequence
ctcatccctgaagactccaa

SEQ ID NO: 809701 - DNA, 20 bp, Artificial
  CRISPR gRNA sequence
atccctgaagactccaaagt

SEQ ID NO: 809702 - DNA, 20 bp, Artificial
  CRISPR gRNA sequence
aagactccaaagttgaacat

SEQ ID NO: 809703 - DNA, 20 bp, Artificial
  CRISPR gRNA sequence
caaagttgaacatccagtag

SEQ ID NO: 809704 - DNA, 20 bp, Artificial
  CRISPR gRNA sequence
aacatccagtaggaaatcag

SEQ ID NO: 809705 - DNA, 20 bp, Artificial
  CRISPR gRNA sequence
cttagactgtatttggaggg

SEQ ID NO: 809706 - DNA, 20 bp, Artificial
  CRISPR gRNA sequence
agactgtatttggagggcaa

SEQ ID NO: 809707 - DNA, 20 bp, Artificial
  CRISPR gRNA sequence
gactgtatttggagggcaaa

SEQ ID NO: 809708 - DNA, 20 bp, Artificial
  CRISPR gRNA sequence
tatttggagggcaaaggcct

SEQ ID NO: 809709 - DNA, 20 bp, Artificial
  CRISPR gRNA sequence
ggagggcaaaggccttatct

SEQ ID NO: 809710 - DNA, 20 bp, Artificial
  CRISPR gRNA sequence
gagggcaaaggccttatcta

SEQ ID NO: 809711 - DNA, 20 bp, Artificial
  CRISPR gRNA sequence
atctaaactacctctgagtc

SEQ ID NO: 809712 - DNA, 20 bp, Artificial
  CRISPR gRNA sequence
tctaaactacctctgagtcc

SEQ ID NO: 809713 - DNA, 20 bp, Artificial
  CRISPR gRNA sequence
aactacctctgagtcctctc

SEQ ID NO: 809714 - DNA, 20 bp, Artificial
  CRISPR gRNA sequence
cctctgagtcctctctagat

SEQ ID NO: 809715 - DNA, 20 bp, Artificial
  CRISPR gRNA sequence
tgagtcctctctagatagag

SEQ ID NO: 809716 - DNA, 20 bp, Artificial
  CRISPR gRNA sequence
agtcctctctagatagagcc

SEQ ID NO: 809717 - DNA, 20 bp, Artificial
  CRISPR gRNA sequence
tctagatagagccaagcaac

SEQ ID NO: 809718 - DNA, 20 bp, Artificial
  CRISPR gRNA sequence
tagatagagccaagcaacag

SEQ ID NO: 809719 - DNA, 20 bp, Artificial
  CRISPR gRNA sequence
gatagagccaagcaacagct

SEQ ID NO: 809720 - DNA, 20 bp, Artificial
  CRISPR gRNA sequence
catgaaaagtgccaatatgg

SEQ ID NO: 809721 - DNA, 20 bp, Artificial
  CRISPR gRNA sequence
ttgcactgaattgactgtct

SEQ ID NO: 809722 - DNA, 20 bp, Artificial
  CRISPR gRNA sequence
cactgaattgactgtctctt

SEQ ID NO: 809723 - DNA, 20 bp, Artificial
  CRISPR gRNA sequence
aattgactgtctcttttcta

SEQ ID NO: 809724 - DNA, 20 bp, Artificial
  CRISPR gRNA sequence
actgtctcttttctagtcca

SEQ ID NO: 809725 - DNA, 20 bp, Artificial
  CRISPR gRNA sequence
tctcttttctagtccaccta

SEQ ID NO: 809726 - DNA, 20 bp, Artificial
  CRISPR gRNA sequence
ttttctagtccacctagcct

SEQ ID NO: 809727 - DNA, 20 bp, Artificial
  CRISPR gRNA sequence
ttctagtccacctagcctga

SEQ ID NO: 809728 - DNA, 20 bp, Artificial
  CRISPR gRNA sequence
tctagtccacctagcctgat

SEQ ID NO: 809729 - DNA, 20 bp, Artificial
  CRISPR gRNA sequence
ctagtccacctagcctgatc

SEQ ID NO: 809730 - DNA, 20 bp, Artificial
  CRISPR gRNA sequence
tagtccacctagcctgatcc

SEQ ID NO: 809731 - DNA, 20 bp, Artificial
  CRISPR gRNA sequence
gtccacctagcctgatcctc

SEQ ID NO: 809732 - DNA, 20 bp, Artificial
  CRISPR gRNA sequence
gcctgatcctcctagtcatt

SEQ ID NO: 809733 - DNA, 20 bp, Artificial
  CRISPR gRNA sequence
atcctcctagtcatttgtta

SEQ ID NO: 809734 - DNA, 20 bp, Artificial
  CRISPR gRNA sequence
ctagtcatttgttaccttgt

SEQ ID NO: 809735 - DNA, 20 bp, Artificial
  CRISPR gRNA sequence
gtcatttgttaccttgtggt

SEQ ID NO: 809736 - DNA, 20 bp, Artificial
  CRISPR gRNA sequence
gttaccttgtggtatactgc

SEQ ID NO: 809737 - DNA, 20 bp, Artificial
  CRISPR gRNA sequence
ttaccttgtggtatactgct

SEQ ID NO: 809738 - DNA, 20 bp, Artificial
  CRISPR gRNA sequence
ccttgtggtatactgctggt

SEQ ID NO: 809739 - DNA, 20 bp, Artificial
  CRISPR gRNA sequence
gtggtatactgctggttaat

SEQ ID NO: 809740 - DNA, 20 bp, Artificial
  CRISPR gRNA sequence
tggtatactgctggttaatc

SEQ ID NO: 809741 - DNA, 20 bp, Artificial
  CRISPR gRNA sequence
ctggttaatccattctttct

SEQ ID NO: 809742 - DNA, 20 bp, Artificial
  CRISPR gRNA sequence
gttaatccattctttctttc

SEQ ID NO: 809743 - DNA, 20 bp, Artificial
  CRISPR gRNA sequence
atccattctttctttcaact

SEQ ID NO: 809744 - DNA, 20 bp, Artificial
  CRISPR gRNA sequence
tttctttcaactttagtatt

SEQ ID NO: 809745 - DNA, 20 bp, Artificial
  CRISPR gRNA sequence
tctttcaactttagtattag

SEQ ID NO: 809746 - DNA, 20 bp, Artificial
  CRISPR gRNA sequence
ctttcaactttagtattagg

SEQ ID NO: 809747 - DNA, 20 bp, Artificial
  CRISPR gRNA sequence
tttcaactttagtattaggg

SEQ ID NO: 809748 - DNA, 20 bp, Artificial
  CRISPR gRNA sequence
tcaactttagtattagggaa

SEQ ID NO: 809749 - DNA, 20 bp, Artificial
  CRISPR gRNA sequence
caactttagtattagggaat

SEQ ID NO: 809750 - DNA, 20 bp, Artificial
  CRISPR gRNA sequence
aactttagtattagggaatt

SEQ ID NO: 809751 - DNA, 20 bp, Artificial
  CRISPR gRNA sequence
tagtattagggaattagctg

SEQ ID NO: 809752 - DNA, 20 bp, Artificial
  CRISPR gRNA sequence
agtattagggaattagctgg

SEQ ID NO: 809753 - DNA, 20 bp, Artificial
  CRISPR gRNA sequence
gtattagggaattagctgga

SEQ ID NO: 809754 - DNA, 20 bp, Artificial
  CRISPR gRNA sequence
gggaattagctggacacatg

SEQ ID NO: 809755 - DNA, 20 bp, Artificial
  CRISPR gRNA sequence
gctggacacatggcttctca

SEQ ID NO: 809756 - DNA, 20 bp, Artificial
  CRISPR gRNA sequence
gacacatggcttctcagaga

SEQ ID NO: 809757 - DNA, 20 bp, Artificial
  CRISPR gRNA sequence
ctcagagactatgtttccaa

SEQ ID NO: 809758 - DNA, 20 bp, Artificial
  CRISPR gRNA sequence
tcagagactatgtttccaag

SEQ ID NO: 809759 - DNA, 20 bp, Artificial
  CRISPR gRNA sequence
agagactatgtttccaagcc

SEQ ID NO: 809760 - DNA, 20 bp, Artificial
  CRISPR gRNA sequence
tgtttccaagcctcccctat

SEQ ID NO: 809761 - DNA, 20 bp, Artificial
  CRISPR gRNA sequence
ccaagcctcccctatagtta

SEQ ID NO: 809762 - DNA, 20 bp, Artificial
  CRISPR gRNA sequence
caagcctcccctatagttaa

SEQ ID NO: 809763 - DNA, 20 bp, Artificial
  CRISPR gRNA sequence
ccctatagttaagtgggccc

SEQ ID NO: 809764 - DNA, 20 bp, Artificial
  CRISPR gRNA sequence
tagttaagtgggcccagcca

SEQ ID NO: 809765 - DNA, 20 bp, Artificial
  CRISPR gRNA sequence
agtgggcccagccatgtaat

SEQ ID NO: 809766 - DNA, 20 bp, Artificial
  CRISPR gRNA sequence
agttcaggctaagagagtga

SEQ ID NO: 809767 - DNA, 20 bp, Artificial
  CRISPR gRNA sequence
aggctaagagagtgagtttt

SEQ ID NO: 809768 - DNA, 20 bp, Artificial
  CRISPR gRNA sequence
agagagtgagttttcaaggt

SEQ ID NO: 809769 - DNA, 20 bp, Artificial
  CRISPR gRNA sequence
tcaaggtcttggccttaaaa

SEQ ID NO: 809770 - DNA, 20 bp, Artificial
  CRISPR gRNA sequence
caaggtcttggccttaaaac

SEQ ID NO: 809771 - DNA, 20 bp, Artificial
  CRISPR gRNA sequence
aaggtcttggccttaaaaca

SEQ ID NO: 809772 - DNA, 20 bp, Artificial
  CRISPR gRNA sequence
ggccttaaaacattgaatgt

SEQ ID NO: 809773 - DNA, 20 bp, Artificial
  CRISPR gRNA sequence
gccttaaaacattgaatgtg

SEQ ID NO: 809774 - DNA, 20 bp, Artificial
  CRISPR gRNA sequence
aaaacattgaatgtgttttc

SEQ ID NO: 809775 - DNA, 20 bp, Artificial
  CRISPR gRNA sequence
aaacattgaatgtgttttcc

SEQ ID NO: 809776 - DNA, 20 bp, Artificial
  CRISPR gRNA sequence
aatgtgttttccaccactcg

SEQ ID NO: 809777 - DNA, 20 bp, Artificial
  CRISPR gRNA sequence
tccaccactcgtttactttc

SEQ ID NO: 809778 - DNA, 20 bp, Artificial
  CRISPR gRNA sequence
ccaccactcgtttactttct

SEQ ID NO: 809779 - DNA, 20 bp, Artificial
  CRISPR gRNA sequence
caccactcgtttactttctg

SEQ ID NO: 809780 - DNA, 20 bp, Artificial
  CRISPR gRNA sequence
gtttactttctgaaggttga

SEQ ID NO: 809781 - DNA, 20 bp, Artificial
  CRISPR gRNA sequence
actttctgaaggttgaaaca

SEQ ID NO: 809782 - DNA, 20 bp, Artificial
  CRISPR gRNA sequence
ctttctgaaggttgaaacat

SEQ ID NO: 809783 - DNA, 20 bp, Artificial
  CRISPR gRNA sequence
tctgaaggttgaaacatggg

SEQ ID NO: 809784 - DNA, 20 bp, Artificial
  CRISPR gRNA sequence
ctgaaggttgaaacatgggt

SEQ ID NO: 809785 - DNA, 20 bp, Artificial
  CRISPR gRNA sequence
tgaaggttgaaacatgggtt

SEQ ID NO: 809786 - DNA, 20 bp, Artificial
  CRISPR gRNA sequence
aaggttgaaacatgggtttg

SEQ ID NO: 809787 - DNA, 20 bp, Artificial
  CRISPR gRNA sequence
aaacatgggtttggcactga

SEQ ID NO: 809788 - DNA, 20 bp, Artificial
  CRISPR gRNA sequence
ggcactgactgagctttgac

SEQ ID NO: 809789 - DNA, 20 bp, Artificial
  CRISPR gRNA sequence
gcactgactgagctttgaca

SEQ ID NO: 809790 - DNA, 20 bp, Artificial
  CRISPR gRNA sequence
actgagctttgacaatttta

SEQ ID NO: 809791 - DNA, 20 bp, Artificial
  CRISPR gRNA sequence
agctttgacaattttatagg

SEQ ID NO: 809792 - DNA, 20 bp, Artificial
  CRISPR gRNA sequence
tgacaattttatagggacaa

SEQ ID NO: 809793 - DNA, 20 bp, Artificial
  CRISPR gRNA sequence
gacaattttatagggacaac

SEQ ID NO: 809794 - DNA, 20 bp, Artificial
  CRISPR gRNA sequence
acaattttatagggacaaca

SEQ ID NO: 809795 - DNA, 20 bp, Artificial
  CRISPR gRNA sequence
tatagggacaacatcctgga

SEQ ID NO: 809796 - DNA, 20 bp, Artificial
  CRISPR gRNA sequence
atagggacaacatcctggag

SEQ ID NO: 809797 - DNA, 20 bp, Artificial
  CRISPR gRNA sequence
tagggacaacatcctggaga

SEQ ID NO: 809798 - DNA, 20 bp, Artificial
  CRISPR gRNA sequence
gagaatggcagagcaacaga

SEQ ID NO: 809799 - DNA, 20 bp, Artificial
  CRISPR gRNA sequence
gatcactgaatgactctatg

SEQ ID NO: 809800 - DNA, 20 bp, Artificial
  CRISPR gRNA sequence
aatgactctatggaacatag

SEQ ID NO: 809801 - DNA, 20 bp, Artificial
  CRISPR gRNA sequence
tatggaacatagctgcttag

SEQ ID NO: 809802 - DNA, 20 bp, Artificial
  CRISPR gRNA sequence
tggaacatagctgcttagct

SEQ ID NO: 809803 - DNA, 20 bp, Artificial
  CRISPR gRNA sequence
cttagctgctctgaaccacc

SEQ ID NO: 809804 - DNA, 20 bp, Artificial
  CRISPR gRNA sequence
agctgctctgaaccacctga

SEQ ID NO: 809805 - DNA, 20 bp, Artificial
  CRISPR gRNA sequence
gctgctctgaaccacctgag

SEQ ID NO: 809806 - DNA, 20 bp, Artificial
  CRISPR gRNA sequence
ctctgaaccacctgagtgtt

SEQ ID NO: 809807 - DNA, 20 bp, Artificial
  CRISPR gRNA sequence
tgaaccacctgagtgttaca

SEQ ID NO: 809808 - DNA, 20 bp, Artificial
  CRISPR gRNA sequence
aaccacctgagtgttacatg

SEQ ID NO: 809809 - DNA, 20 bp, Artificial
  CRISPR gRNA sequence
agtgttacatggaacgaaag

SEQ ID NO: 809810 - DNA, 20 bp, Artificial
  CRISPR gRNA sequence
catggaacgaaagatacttc

SEQ ID NO: 809811 - DNA, 20 bp, Artificial
  CRISPR gRNA sequence
ctgtctcgcttctcactgta

SEQ ID NO: 809812 - DNA, 20 bp, Artificial
  CRISPR gRNA sequence
tgtctcgcttctcactgtat

SEQ ID NO: 809813 - DNA, 20 bp, Artificial
  CRISPR gRNA sequence
tctcgcttctcactgtattt

SEQ ID NO: 809814 - DNA, 20 bp, Artificial
  CRISPR gRNA sequence
gcttctcactgtatttcgag

SEQ ID NO: 809815 - DNA, 20 bp, Artificial
  CRISPR gRNA sequence
ctcactgtatttcgaggtct

SEQ ID NO: 809816 - DNA, 20 bp, Artificial
  CRISPR gRNA sequence
tcactgtatttcgaggtctc

SEQ ID NO: 809817 - DNA, 20 bp, Artificial
  CRISPR gRNA sequence
actgtatttcgaggtctctt

SEQ ID NO: 809818 - DNA, 20 bp, Artificial
  CRISPR gRNA sequence
tatttcgaggtctcttcatt

SEQ ID NO: 809819 - DNA, 20 bp, Artificial
  CRISPR gRNA sequence
cgaggtctcttcattatggt

SEQ ID NO: 809820 - DNA, 20 bp, Artificial
  CRISPR gRNA sequence
gaggtctcttcattatggta

SEQ ID NO: 809821 - DNA, 20 bp, Artificial
  CRISPR gRNA sequence
ttcattatggtagcttagcc

SEQ ID NO: 809822 - DNA, 20 bp, Artificial
  CRISPR gRNA sequence
cattatggtagcttagcctg

SEQ ID NO: 809823 - DNA, 20 bp, Artificial
  CRISPR gRNA sequence
attatggtagcttagcctgt

SEQ ID NO: 809824 - DNA, 20 bp, Artificial
  CRISPR gRNA sequence
tggtagcttagcctgtatcc

SEQ ID NO: 809825 - DNA, 20 bp, Artificial
  CRISPR gRNA sequence
agcctgtatcctcatacata

SEQ ID NO: 809826 - DNA, 20 bp, Artificial
  CRISPR gRNA sequence
gcctgtatcctcatacatat

SEQ ID NO: 809827 - DNA, 20 bp, Artificial
  CRISPR gRNA sequence
tatcctcatacatattcctc

SEQ ID NO: 809828 - DNA, 20 bp, Artificial
  CRISPR gRNA sequence
atacatattcctctaagttg

SEQ ID NO: 809829 - DNA, 20 bp, Artificial
  CRISPR gRNA sequence
ctctaagttgttttaaaatt

SEQ ID NO: 809830 - DNA, 20 bp, Artificial
  CRISPR gRNA sequence
taagttgttttaaaattctt

SEQ ID NO: 809831 - DNA, 20 bp, Artificial
  CRISPR gRNA sequence
agttgttttaaaattcttgc

SEQ ID NO: 809832 - DNA, 20 bp, Artificial
  CRISPR gRNA sequence
ttttaaaattcttgcatact

SEQ ID NO: 809833 - DNA, 20 bp, Artificial
  CRISPR gRNA sequence
taaaattcttgcatactctt

SEQ ID NO: 809834 - DNA, 20 bp, Artificial
  CRISPR gRNA sequence
aaaattcttgcatactcttt

SEQ ID NO: 809835 - DNA, 20 bp, Artificial
  CRISPR gRNA sequence
aaattcttgcatactctttt

SEQ ID NO: 809836 - DNA, 20 bp, Artificial
  CRISPR gRNA sequence
ttgcatactcttttgtcgtt

SEQ ID NO: 809837 - DNA, 20 bp, Artificial
  CRISPR gRNA sequence
gcatactcttttgtcgtttc

SEQ ID NO: 809838 - DNA, 20 bp, Artificial
  CRISPR gRNA sequence
catactcttttgtcgtttct

SEQ ID NO: 809839 - DNA, 20 bp, Artificial
  CRISPR gRNA sequence
ttttgtcgtttctttaattt

SEQ ID NO: 809840 - DNA, 20 bp, Artificial
  CRISPR gRNA sequence
ttgtcgtttctttaatttaa

SEQ ID NO: 809841 - DNA, 20 bp, Artificial
  CRISPR gRNA sequence
tgtcgtttctttaatttaat

SEQ ID NO: 809842 - DNA, 20 bp, Artificial
  CRISPR gRNA sequence
gtcgtttctttaatttaatt

SEQ ID NO: 809843 - DNA, 20 bp, Artificial
  CRISPR gRNA sequence
tcgtttctttaatttaatta

SEQ ID NO: 809844 - DNA, 20 bp, Artificial
  CRISPR gRNA sequence
ctttaatttaattaattaat

SEQ ID NO: 809845 - DNA, 20 bp, Artificial
  CRISPR gRNA sequence
tttaatttaattaattaatt

SEQ ID NO: 809846 - DNA, 20 bp, Artificial
  CRISPR gRNA sequence
taatttaattaattaattta

SEQ ID NO: 809847 - DNA, 20 bp, Artificial
  CRISPR gRNA sequence
aatttaattaattaatttat

SEQ ID NO: 809848 - DNA, 20 bp, Artificial
  CRISPR gRNA sequence
atttaattaattaatttatt

SEQ ID NO: 809849 - DNA, 20 bp, Artificial
  CRISPR gRNA sequence
aattaattaatttatttatt

SEQ ID NO: 809850 - DNA, 20 bp, Artificial
  CRISPR gRNA sequence
attaattaatttatttattt

SEQ ID NO: 809851 - DNA, 20 bp, Artificial
  CRISPR gRNA sequence
attaatttatttatttgaga

SEQ ID NO: 809852 - DNA, 20 bp, Artificial
  CRISPR gRNA sequence
atttatttatttgagaagga

SEQ ID NO: 809853 - DNA, 20 bp, Artificial
  CRISPR gRNA sequence
atttatttgagaaggagttt

SEQ ID NO: 809854 - DNA, 20 bp, Artificial
  CRISPR gRNA sequence
tttatttgagaaggagtttc

SEQ ID NO: 809855 - DNA, 20 bp, Artificial
  CRISPR gRNA sequence
atttgagaaggagtttccct

SEQ ID NO: 809856 - DNA, 20 bp, Artificial
  CRISPR gRNA sequence
tttgagaaggagtttccctc

SEQ ID NO: 809857 - DNA, 20 bp, Artificial
  CRISPR gRNA sequence
gagaaggagtttccctcttg

SEQ ID NO: 809858 - DNA, 20 bp, Artificial
  CRISPR gRNA sequence
agaaggagtttccctcttgt

SEQ ID NO: 809859 - DNA, 20 bp, Artificial
  CRISPR gRNA sequence
ccctcttgttgcccaggctg

SEQ ID NO: 809860 - DNA, 20 bp, Artificial
  CRISPR gRNA sequence
cctcttgttgcccaggctgg

SEQ ID NO: 809861 - DNA, 20 bp, Artificial
  CRISPR gRNA sequence
ttgttgcccaggctggagtg

SEQ ID NO: 809862 - DNA, 20 bp, Artificial
  CRISPR gRNA sequence
gttgcccaggctggagtgca

SEQ ID NO: 809863 - DNA, 20 bp, Artificial
  CRISPR gRNA sequence
ttgcccaggctggagtgcag

SEQ ID NO: 809864 - DNA, 20 bp, Artificial
  CRISPR gRNA sequence
cccaggctggagtgcagtgg

SEQ ID NO: 809865 - DNA, 20 bp, Artificial
  CRISPR gRNA sequence
gagtgcagtggcatgatctt

SEQ ID NO: 809866 - DNA, 20 bp, Artificial
  CRISPR gRNA sequence
ggctcactgcaacctccgcc

SEQ ID NO: 809867 - DNA, 20 bp, Artificial
  CRISPR gRNA sequence
gctcactgcaacctccgcct

SEQ ID NO: 809868 - DNA, 20 bp, Artificial
  CRISPR gRNA sequence
actgcaacctccgcctcctg

SEQ ID NO: 809869 - DNA, 20 bp, Artificial
  CRISPR gRNA sequence
caacctccgcctcctgggtt

SEQ ID NO: 809870 - DNA, 20 bp, Artificial
  CRISPR gRNA sequence
cgcctcctgggttcaagtga

SEQ ID NO: 809871 - DNA, 20 bp, Artificial
  CRISPR gRNA sequence
ctgggttcaagtgattctcc

SEQ ID NO: 809872 - DNA, 20 bp, Artificial
  CRISPR gRNA sequence
ggttcaagtgattctcctgc

SEQ ID NO: 809873 - DNA, 20 bp, Artificial
  CRISPR gRNA sequence
aagtgattctcctgcctcgg

SEQ ID NO: 809874 - DNA, 20 bp, Artificial
  CRISPR gRNA sequence
tcctgcctcggcctcttgag

SEQ ID NO: 809875 - DNA, 20 bp, Artificial
  CRISPR gRNA sequence
ctgcctcggcctcttgagta

SEQ ID NO: 809876 - DNA, 20 bp, Artificial
  CRISPR gRNA sequence
cctcggcctcttgagtagct

SEQ ID NO: 809877 - DNA, 20 bp, Artificial
  CRISPR gRNA sequence
ggcctcttgagtagctggga

SEQ ID NO: 809878 - DNA, 20 bp, Artificial
  CRISPR gRNA sequence
ttgagtagctgggattacag

SEQ ID NO: 809879 - DNA, 20 bp, Artificial
  CRISPR gRNA sequence
gagtagctgggattacaggc

SEQ ID NO: 809880 - DNA, 20 bp, Artificial
  CRISPR gRNA sequence
agtagctgggattacaggca

SEQ ID NO: 809881 - DNA, 20 bp, Artificial
  CRISPR gRNA sequence
ggattacaggcacctgccac

SEQ ID NO: 809882 - DNA, 20 bp, Artificial
  CRISPR gRNA sequence
caggcacctgccaccatgcc

SEQ ID NO: 809883 - DNA, 20 bp, Artificial
  CRISPR gRNA sequence
ccaccatgcctggctaattt

SEQ ID NO: 809884 - DNA, 20 bp, Artificial
  CRISPR gRNA sequence
gctaattttttgtattttta

SEQ ID NO: 809885 - DNA, 20 bp, Artificial
  CRISPR gRNA sequence
attttttgtatttttagtag

SEQ ID NO: 809886 - DNA, 20 bp, Artificial
  CRISPR gRNA sequence
tttgtatttttagtagagac

SEQ ID NO: 809887 - DNA, 20 bp, Artificial
  CRISPR gRNA sequence
ttgtatttttagtagagacg

SEQ ID NO: 809888 - DNA, 20 bp, Artificial
  CRISPR gRNA sequence
tgtatttttagtagagacgg

SEQ ID NO: 809889 - DNA, 20 bp, Artificial
  CRISPR gRNA sequence
gtatttttagtagagacggg

SEQ ID NO: 809890 - DNA, 20 bp, Artificial
  CRISPR gRNA sequence
tatttttagtagagacgggg

SEQ ID NO: 809891 - DNA, 20 bp, Artificial
  CRISPR gRNA sequence
ttagtagagacggggtttca

SEQ ID NO: 809892 - DNA, 20 bp, Artificial
  CRISPR gRNA sequence
tagtagagacggggtttcac

SEQ ID NO: 809893 - DNA, 20 bp, Artificial
  CRISPR gRNA sequence
agtagagacggggtttcacc

SEQ ID NO: 809894 - DNA, 20 bp, Artificial
  CRISPR gRNA sequence
gtagagacggggtttcacca

SEQ ID NO: 809895 - DNA, 20 bp, Artificial
  CRISPR gRNA sequence
caccatgttagccaggctga

SEQ ID NO: 809896 - DNA, 20 bp, Artificial
  CRISPR gRNA sequence
accatgttagccaggctgat

SEQ ID NO: 809897 - DNA, 20 bp, Artificial
  CRISPR gRNA sequence
gccaggctgatttttgaact

SEQ ID NO: 809898 - DNA, 20 bp, Artificial
  CRISPR gRNA sequence
atttttgaactcctggcctc

SEQ ID NO: 809899 - DNA, 20 bp, Artificial
  CRISPR gRNA sequence
ttgaactcctggcctcaagc

SEQ ID NO: 809900 - DNA, 20 bp, Artificial
  CRISPR gRNA sequence
tgaactcctggcctcaagca

SEQ ID NO: 809901 - DNA, 20 bp, Artificial
  CRISPR gRNA sequence
gaactcctggcctcaagcaa

SEQ ID NO: 809902 - DNA, 20 bp, Artificial
  CRISPR gRNA sequence
aactcctggcctcaagcaat

SEQ ID NO: 809903 - DNA, 20 bp, Artificial
  CRISPR gRNA sequence
ctggcctcaagcaatccacc

SEQ ID NO: 809904 - DNA, 20 bp, Artificial
  CRISPR gRNA sequence
gcctcaagcaatccacccat

SEQ ID NO: 809905 - DNA, 20 bp, Artificial
  CRISPR gRNA sequence
aagcaatccacccatctcag

SEQ ID NO: 809906 - DNA, 20 bp, Artificial
  CRISPR gRNA sequence
agcctcccaaagtgctagga

SEQ ID NO: 809907 - DNA, 20 bp, Artificial
  CRISPR gRNA sequence
ccaaagtgctaggattacag

SEQ ID NO: 809908 - DNA, 20 bp, Artificial
  CRISPR gRNA sequence
ggattacaggcatgagccac

SEQ ID NO: 809909 - DNA, 20 bp, Artificial
  CRISPR gRNA sequence
caggcatgagccaccgcacc

SEQ ID NO: 809910 - DNA, 20 bp, Artificial
  CRISPR gRNA sequence
gccaataatggcatactctt

SEQ ID NO: 809911 - DNA, 20 bp, Artificial
  CRISPR gRNA sequence
ttagcaatgatataatgatg

SEQ ID NO: 809912 - DNA, 20 bp, Artificial
  CRISPR gRNA sequence
agcaatgatataatgatgca

SEQ ID NO: 809913 - DNA, 20 bp, Artificial
  CRISPR gRNA sequence
gcaatgatataatgatgcaa

SEQ ID NO: 809914 - DNA, 20 bp, Artificial
  CRISPR gRNA sequence
gtcttatccttgccacaact

SEQ ID NO: 809915 - DNA, 20 bp, Artificial
  CRISPR gRNA sequence
tcttatccttgccacaactt

SEQ ID NO: 809916 - DNA, 20 bp, Artificial
  CRISPR gRNA sequence
atccttgccacaacttcatg

SEQ ID NO: 809917 - DNA, 20 bp, Artificial
  CRISPR gRNA sequence
tccttgccacaacttcatga

SEQ ID NO: 809918 - DNA, 20 bp, Artificial
  CRISPR gRNA sequence
gccacaacttcatgaactca

SEQ ID NO: 809919 - DNA, 20 bp, Artificial
  CRISPR gRNA sequence
ccacaacttcatgaactcac

SEQ ID NO: 809920 - DNA, 20 bp, Artificial
  CRISPR gRNA sequence
catgaactcacaagtaaggc

SEQ ID NO: 809921 - DNA, 20 bp, Artificial
  CRISPR gRNA sequence
atgaactcacaagtaaggca

SEQ ID NO: 809922 - DNA, 20 bp, Artificial
  CRISPR gRNA sequence
acaagtaaggcatgcaactt

SEQ ID NO: 809923 - DNA, 20 bp, Artificial
  CRISPR gRNA sequence
gctagatataccattttttt

SEQ ID NO: 809924 - DNA, 20 bp, Artificial
  CRISPR gRNA sequence
ctagatataccatttttttt

SEQ ID NO: 809925 - DNA, 20 bp, Artificial
  CRISPR gRNA sequence
gatataccatttttttttac

SEQ ID NO: 809926 - DNA, 20 bp, Artificial
  CRISPR gRNA sequence
ttttttactgtttgcacact

SEQ ID NO: 809927 - DNA, 20 bp, Artificial
  CRISPR gRNA sequence
tttttactgtttgcacactt

SEQ ID NO: 809928 - DNA, 20 bp, Artificial
  CRISPR gRNA sequence
ttttactgtttgcacacttt

SEQ ID NO: 809929 - DNA, 20 bp, Artificial
  CRISPR gRNA sequence
tttactgtttgcacactttc

SEQ ID NO: 809930 - DNA, 20 bp, Artificial
  CRISPR gRNA sequence
ttactgtttgcacactttct

SEQ ID NO: 809931 - DNA, 20 bp, Artificial
  CRISPR gRNA sequence
tactgtttgcacactttctg

SEQ ID NO: 809932 - DNA, 20 bp, Artificial
  CRISPR gRNA sequence
actgtttgcacactttctga

SEQ ID NO: 809933 - DNA, 20 bp, Artificial
  CRISPR gRNA sequence
ctgtttgcacactttctgag

SEQ ID NO: 809934 - DNA, 20 bp, Artificial
  CRISPR gRNA sequence
tttgcacactttctgagtac

SEQ ID NO: 809935 - DNA, 20 bp, Artificial
  CRISPR gRNA sequence
gcacactttctgagtactaa

SEQ ID NO: 809936 - DNA, 20 bp, Artificial
  CRISPR gRNA sequence
cacactttctgagtactaag

SEQ ID NO: 809937 - DNA, 20 bp, Artificial
  CRISPR gRNA sequence
tctgagtactaagcacttta

SEQ ID NO: 809938 - DNA, 20 bp, Artificial
  CRISPR gRNA sequence
ctgagtactaagcactttat

SEQ ID NO: 809939 - DNA, 20 bp, Artificial
  CRISPR gRNA sequence
tgagtactaagcactttata

SEQ ID NO: 809940 - DNA, 20 bp, Artificial
  CRISPR gRNA sequence
agtactaagcactttataag

SEQ ID NO: 809941 - DNA, 20 bp, Artificial
  CRISPR gRNA sequence
agcactttataagcacattt

SEQ ID NO: 809942 - DNA, 20 bp, Artificial
  CRISPR gRNA sequence
tataagcacatttcatttaa

SEQ ID NO: 809943 - DNA, 20 bp, Artificial
  CRISPR gRNA sequence
ataagcacatttcatttaat

SEQ ID NO: 809944 - DNA, 20 bp, Artificial
  CRISPR gRNA sequence
taagcacatttcatttaatc

SEQ ID NO: 809945 - DNA, 20 bp, Artificial
  CRISPR gRNA sequence
catttaatcctcactataac

SEQ ID NO: 809946 - DNA, 20 bp, Artificial
  CRISPR gRNA sequence
atttaatcctcactataacc

SEQ ID NO: 809947 - DNA, 20 bp, Artificial
  CRISPR gRNA sequence
aatcctcactataaccctat

SEQ ID NO: 809948 - DNA, 20 bp, Artificial
  CRISPR gRNA sequence
atcctcactataaccctata

SEQ ID NO: 809949 - DNA, 20 bp, Artificial
  CRISPR gRNA sequence
actataaccctataaactgt

SEQ ID NO: 809950 - DNA, 20 bp, Artificial
  CRISPR gRNA sequence
taaccctataaactgtctac

SEQ ID NO: 809951 - DNA, 20 bp, Artificial
  CRISPR gRNA sequence
taaactgtctaccactactc

SEQ ID NO: 809952 - DNA, 20 bp, Artificial
  CRISPR gRNA sequence
tctaccactactcaccctca

SEQ ID NO: 809953 - DNA, 20 bp, Artificial
  CRISPR gRNA sequence
ccactactcaccctcatgct

SEQ ID NO: 809954 - DNA, 20 bp, Artificial
  CRISPR gRNA sequence
ctcaccctcatgctacacat

SEQ ID NO: 809955 - DNA, 20 bp, Artificial
  CRISPR gRNA sequence
accctcatgctacacatgag

SEQ ID NO: 809956 - DNA, 20 bp, Artificial
  CRISPR gRNA sequence
atgctacacatgagagactg

SEQ ID NO: 809957 - DNA, 20 bp, Artificial
  CRISPR gRNA sequence
cacatgagagactgagtgct

SEQ ID NO: 809958 - DNA, 20 bp, Artificial
  CRISPR gRNA sequence
agtgctagagtggctaagta

SEQ ID NO: 809959 - DNA, 20 bp, Artificial
  CRISPR gRNA sequence
gagtggctaagtaggatatt

SEQ ID NO: 809960 - DNA, 20 bp, Artificial
  CRISPR gRNA sequence
agtaggatatttaggttctc

SEQ ID NO: 809961 - DNA, 20 bp, Artificial
  CRISPR gRNA sequence
aggttctcaaagctaataga

SEQ ID NO: 809962 - DNA, 20 bp, Artificial
  CRISPR gRNA sequence
ggttctcaaagctaatagag

SEQ ID NO: 809963 - DNA, 20 bp, Artificial
  CRISPR gRNA sequence
tcaaagctaatagagagaga

SEQ ID NO: 809964 - DNA, 20 bp, Artificial
  CRISPR gRNA sequence
aaagctaatagagagagagt

SEQ ID NO: 809965 - DNA, 20 bp, Artificial
  CRISPR gRNA sequence
atagagagagagtttgaaat

SEQ ID NO: 809966 - DNA, 20 bp, Artificial
  CRISPR gRNA sequence
gaaatttaagcctgtctgac

SEQ ID NO: 809967 - DNA, 20 bp, Artificial
  CRISPR gRNA sequence
aaatttaagcctgtctgaca

SEQ ID NO: 809968 - DNA, 20 bp, Artificial
  CRISPR gRNA sequence
aagcctgtctgacatcagag

SEQ ID NO: 809969 - DNA, 20 bp, Artificial
  CRISPR gRNA sequence
agcctgtctgacatcagagc

SEQ ID NO: 809970 - DNA, 20 bp, Artificial
  CRISPR gRNA sequence
tctgacatcagagcccatgc

SEQ ID NO: 809971 - DNA, 20 bp, Artificial
  CRISPR gRNA sequence
acatcagagcccatgctctc

SEQ ID NO: 809972 - DNA, 20 bp, Artificial
  CRISPR gRNA sequence
tcaaccactgcctggaatca

SEQ ID NO: 809973 - DNA, 20 bp, Artificial
  CRISPR gRNA sequence
aaccactgcctggaatcacc

SEQ ID NO: 809974 - DNA, 20 bp, Artificial
  CRISPR gRNA sequence
cctggaatcacctccaggtc

SEQ ID NO: 809975 - DNA, 20 bp, Artificial
  CRISPR gRNA sequence
gaatcacctccaggtctcct

SEQ ID NO: 809976 - DNA, 20 bp, Artificial
  CRISPR gRNA sequence
caggtctcctaggaaggatt

SEQ ID NO: 809977 - DNA, 20 bp, Artificial
  CRISPR gRNA sequence
ctaggaaggattctcttttc

SEQ ID NO: 809978 - DNA, 20 bp, Artificial
  CRISPR gRNA sequence
ggaaggattctcttttctgc

SEQ ID NO: 809979 - DNA, 20 bp, Artificial
  CRISPR gRNA sequence
tcttttctgccagccctaca

SEQ ID NO: 809980 - DNA, 20 bp, Artificial
  CRISPR gRNA sequence
ttttctgccagccctacaag

SEQ ID NO: 809981 - DNA, 20 bp, Artificial
  CRISPR gRNA sequence
ttctgccagccctacaaggg

SEQ ID NO: 809982 - DNA, 20 bp, Artificial
  CRISPR gRNA sequence
tctgccagccctacaagggt

SEQ ID NO: 809983 - DNA, 20 bp, Artificial
  CRISPR gRNA sequence
ctgccagccctacaagggtc

SEQ ID NO: 809984 - DNA, 20 bp, Artificial
  CRISPR gRNA sequence
tgccagccctacaagggtcc

SEQ ID NO: 809985 - DNA, 20 bp, Artificial
  CRISPR gRNA sequence
ccagccctacaagggtcctt

SEQ ID NO: 809986 - DNA, 20 bp, Artificial
  CRISPR gRNA sequence
caagggtccttttatattta

SEQ ID NO: 809987 - DNA, 20 bp, Artificial
  CRISPR gRNA sequence
ttatatttattttttgtgct

SEQ ID NO: 809988 - DNA, 20 bp, Artificial
  CRISPR gRNA sequence
tatatttattttttgtgctg

SEQ ID NO: 809989 - DNA, 20 bp, Artificial
  CRISPR gRNA sequence
atatttattttttgtgctgt

SEQ ID NO: 809990 - DNA, 20 bp, Artificial
  CRISPR gRNA sequence
tatttattttttgtgctgta

SEQ ID NO: 809991 - DNA, 20 bp, Artificial
  CRISPR gRNA sequence
attttttgtgctgtagtccc

SEQ ID NO: 809992 - DNA, 20 bp, Artificial
  CRISPR gRNA sequence
ttttttgtgctgtagtccca

SEQ ID NO: 809993 - DNA, 20 bp, Artificial
  CRISPR gRNA sequence
tttgtgctgtagtcccattc

SEQ ID NO: 809994 - DNA, 20 bp, Artificial
  CRISPR gRNA sequence
ttgtgctgtagtcccattcc

SEQ ID NO: 809995 - DNA, 20 bp, Artificial
  CRISPR gRNA sequence
tgtgctgtagtcccattcca

SEQ ID NO: 809996 - DNA, 20 bp, Artificial
  CRISPR gRNA sequence
gtgctgtagtcccattccat

SEQ ID NO: 809997 - DNA, 20 bp, Artificial
  CRISPR gRNA sequence
tgctgtagtcccattccatt

SEQ ID NO: 809998 - DNA, 20 bp, Artificial
  CRISPR gRNA sequence
tagtcccattccatttccta

SEQ ID NO: 809999 - DNA, 20 bp, Artificial
  CRISPR gRNA sequence
catttcctaatgaaaataca

SEQ ID NO: 810000 - DNA, 20 bp, Artificial
  CRISPR gRNA sequence
cctaatgaaaatacaacaac

SEQ ID NO: 810001 - DNA, 20 bp, Artificial
  CRISPR gRNA sequence
ctaatgaaaatacaacaact

SEQ ID NO: 810002 - DNA, 20 bp, Artificial
  CRISPR gRNA sequence
atgaaaatacaacaactggc

SEQ ID NO: 810003 - DNA, 20 bp, Artificial
  CRISPR gRNA sequence
gctgagcagaagaaacccta

SEQ ID NO: 810004 - DNA, 20 bp, Artificial
  CRISPR gRNA sequence
agcagaagaaaccctatttc

SEQ ID NO: 810005 - DNA, 20 bp, Artificial
  CRISPR gRNA sequence
tttcaaaaggaaaatgatct

SEQ ID NO: 810006 - DNA, 20 bp, Artificial
  CRISPR gRNA sequence
caaaaggaaaatgatctgtt

SEQ ID NO: 810007 - DNA, 20 bp, Artificial
  CRISPR gRNA sequence
aaaaggaaaatgatctgttg

SEQ ID NO: 810008 - DNA, 20 bp, Artificial
  CRISPR gRNA sequence
ttgctccctaacttgtgctt

SEQ ID NO: 810009 - DNA, 20 bp, Artificial
  CRISPR gRNA sequence
ctccctaacttgtgcttgaa

SEQ ID NO: 810010 - DNA, 20 bp, Artificial
  CRISPR gRNA sequence
cctaacttgtgcttgaaatt

SEQ ID NO: 810011 - DNA, 20 bp, Artificial
  CRISPR gRNA sequence
acttgtgcttgaaatttgga

SEQ ID NO: 810012 - DNA, 20 bp, Artificial
  CRISPR gRNA sequence
gtgcttgaaatttggaatgt

SEQ ID NO: 810013 - DNA, 20 bp, Artificial
  CRISPR gRNA sequence
tgcttgaaatttggaatgtt

SEQ ID NO: 810014 - DNA, 20 bp, Artificial
  CRISPR gRNA sequence
gaaatttggaatgttcagtc

SEQ ID NO: 810015 - DNA, 20 bp, Artificial
  CRISPR gRNA sequence
aaatttggaatgttcagtca

SEQ ID NO: 810016 - DNA, 20 bp, Artificial
  CRISPR gRNA sequence
ggaatgttcagtcatccatt

SEQ ID NO: 810017 - DNA, 20 bp, Artificial
  CRISPR gRNA sequence
gaatgttcagtcatccattc

SEQ ID NO: 810018 - DNA, 20 bp, Artificial
  CRISPR gRNA sequence
agtcatccattctagagtca

SEQ ID NO: 810019 - DNA, 20 bp, Artificial
  CRISPR gRNA sequence
tagagtcagtggagtaccct

SEQ ID NO: 810020 - DNA, 20 bp, Artificial
  CRISPR gRNA sequence
gagtcagtggagtaccctcc

SEQ ID NO: 810021 - DNA, 20 bp, Artificial
  CRISPR gRNA sequence
cacccaccatactcttcgtt

SEQ ID NO: 810022 - DNA, 20 bp, Artificial
  CRISPR gRNA sequence
ttcgtttccgtgtttgtttt

SEQ ID NO: 810023 - DNA, 20 bp, Artificial
  CRISPR gRNA sequence
cgtttccgtgtttgttttat

SEQ ID NO: 810024 - DNA, 20 bp, Artificial
  CRISPR gRNA sequence
gtttccgtgtttgttttata

SEQ ID NO: 810025 - DNA, 20 bp, Artificial
  CRISPR gRNA sequence
ccgtgtttgttttatacatt

SEQ ID NO: 810026 - DNA, 20 bp, Artificial
  CRISPR gRNA sequence
cgtgtttgttttatacattg

SEQ ID NO: 810027 - DNA, 20 bp, Artificial
  CRISPR gRNA sequence
gttttatacattgacttccg

SEQ ID NO: 810028 - DNA, 20 bp, Artificial
  CRISPR gRNA sequence
ttttatacattgacttccgg

SEQ ID NO: 810029 - DNA, 20 bp, Artificial
  CRISPR gRNA sequence
tatacattgacttccggaga

SEQ ID NO: 810030 - DNA, 20 bp, Artificial
  CRISPR gRNA sequence
atacattgacttccggagaa

SEQ ID NO: 810031 - DNA, 20 bp, Artificial
  CRISPR gRNA sequence
tacattgacttccggagaag

SEQ ID NO: 810032 - DNA, 20 bp, Artificial
  CRISPR gRNA sequence
acttccggagaagcttgtgg

SEQ ID NO: 810033 - DNA, 20 bp, Artificial
  CRISPR gRNA sequence
ccggagaagcttgtgggtca

SEQ ID NO: 810034 - DNA, 20 bp, Artificial
  CRISPR gRNA sequence
cggagaagcttgtgggtcac

SEQ ID NO: 810035 - DNA, 20 bp, Artificial
  CRISPR gRNA sequence
gtgggtcacagcagtccaca

SEQ ID NO: 810036 - DNA, 20 bp, Artificial
  CRISPR gRNA sequence
tgggtcacagcagtccacag

SEQ ID NO: 810037 - DNA, 20 bp, Artificial
  CRISPR gRNA sequence
aatttatgagaatgagtaga

SEQ ID NO: 810038 - DNA, 20 bp, Artificial
  CRISPR gRNA sequence
atgagaatgagtagaaaggg

SEQ ID NO: 810039 - DNA, 20 bp, Artificial
  CRISPR gRNA sequence
tgagaatgagtagaaaggga

SEQ ID NO: 810040 - DNA, 20 bp, Artificial
  CRISPR gRNA sequence
aaaaatgcccttgagaaata

SEQ ID NO: 810041 - DNA, 20 bp, Artificial
  CRISPR gRNA sequence
aaaatgcccttgagaaatag

SEQ ID NO: 810042 - DNA, 20 bp, Artificial
  CRISPR gRNA sequence
gagaaatagaagccaggaac

SEQ ID NO: 810043 - DNA, 20 bp, Artificial
  CRISPR gRNA sequence
agaaatagaagccaggaact

SEQ ID NO: 810044 - DNA, 20 bp, Artificial
  CRISPR gRNA sequence
agaggcagatgtgtgacttt

SEQ ID NO: 810045 - DNA, 20 bp, Artificial
  CRISPR gRNA sequence
tggttattttgttgctggta

SEQ ID NO: 810046 - DNA, 20 bp, Artificial
  CRISPR gRNA sequence
ggttattttgttgctggtat

SEQ ID NO: 810047 - DNA, 20 bp, Artificial
  CRISPR gRNA sequence
gttattttgttgctggtatt

SEQ ID NO: 810048 - DNA, 20 bp, Artificial
  CRISPR gRNA sequence
ttttgttgctggtatttgtg

SEQ ID NO: 810049 - DNA, 20 bp, Artificial
  CRISPR gRNA sequence
tgttgctggtatttgtgcca

SEQ ID NO: 810050 - DNA, 20 bp, Artificial
  CRISPR gRNA sequence
gttgctggtatttgtgccac

SEQ ID NO: 810051 - DNA, 20 bp, Artificial
  CRISPR gRNA sequence
ttgctggtatttgtgccaca

SEQ ID NO: 810052 - DNA, 20 bp, Artificial
  CRISPR gRNA sequence
ctggtatttgtgccacaagc

SEQ ID NO: 810053 - DNA, 20 bp, Artificial
  CRISPR gRNA sequence
gtatttgtgccacaagctag

SEQ ID NO: 810054 - DNA, 20 bp, Artificial
  CRISPR gRNA sequence
gtgccacaagctagaatatc

SEQ ID NO: 810055 - DNA, 20 bp, Artificial
  CRISPR gRNA sequence
tgccacaagctagaatatca

SEQ ID NO: 810056 - DNA, 20 bp, Artificial
  CRISPR gRNA sequence
gaatatcatttggctgctct

SEQ ID NO: 810057 - DNA, 20 bp, Artificial
  CRISPR gRNA sequence
ggctgctctgacctggctgt

SEQ ID NO: 810058 - DNA, 20 bp, Artificial
  CRISPR gRNA sequence
gctgctctgacctggctgtc

SEQ ID NO: 810059 - DNA, 20 bp, Artificial
  CRISPR gRNA sequence
ctctgacctggctgtccaca

SEQ ID NO: 810060 - DNA, 20 bp, Artificial
  CRISPR gRNA sequence
tgacctggctgtccacacag

SEQ ID NO: 810061 - DNA, 20 bp, Artificial
  CRISPR gRNA sequence
acctggctgtccacacagtc

SEQ ID NO: 810062 - DNA, 20 bp, Artificial
  CRISPR gRNA sequence
gctgtccacacagtctggta

SEQ ID NO: 810063 - DNA, 20 bp, Artificial
  CRISPR gRNA sequence
tccacacagtctggtagctg

SEQ ID NO: 810064 - DNA, 20 bp, Artificial
  CRISPR gRNA sequence
gtagctggcatgatgggact

SEQ ID NO: 810065 - DNA, 20 bp, Artificial
  CRISPR gRNA sequence
gcatgatgggactgcgatta

SEQ ID NO: 810066 - DNA, 20 bp, Artificial
  CRISPR gRNA sequence
cgattatctaagatggaatc

SEQ ID NO: 810067 - DNA, 20 bp, Artificial
  CRISPR gRNA sequence
tctaagatggaatctccaac

SEQ ID NO: 810068 - DNA, 20 bp, Artificial
  CRISPR gRNA sequence
agatggaatctccaacccaa

SEQ ID NO: 810069 - DNA, 20 bp, Artificial
  CRISPR gRNA sequence
caacccaatcaacccaacat

SEQ ID NO: 810070 - DNA, 20 bp, Artificial
  CRISPR gRNA sequence
gttgagcacttattatgaac

SEQ ID NO: 810071 - DNA, 20 bp, Artificial
  CRISPR gRNA sequence
ttgagcacttattatgaaca

SEQ ID NO: 810072 - DNA, 20 bp, Artificial
  CRISPR gRNA sequence
agcacttattatgaacacag

SEQ ID NO: 810073 - DNA, 20 bp, Artificial
  CRISPR gRNA sequence
attatgaacacaggactctg

SEQ ID NO: 810074 - DNA, 20 bp, Artificial
  CRISPR gRNA sequence
ttatgaacacaggactctgc

SEQ ID NO: 810075 - DNA, 20 bp, Artificial
  CRISPR gRNA sequence
tgaacacaggactctgcttt

SEQ ID NO: 810076 - DNA, 20 bp, Artificial
  CRISPR gRNA sequence
tgcttttgccttagtgtgga

SEQ ID NO: 810077 - DNA, 20 bp, Artificial
  CRISPR gRNA sequence
cttttgccttagtgtggaat

SEQ ID NO: 810078 - DNA, 20 bp, Artificial
  CRISPR gRNA sequence
ttgccttagtgtggaataaa

SEQ ID NO: 810079 - DNA, 20 bp, Artificial
  CRISPR gRNA sequence
tgccttagtgtggaataaag

SEQ ID NO: 810080 - DNA, 20 bp, Artificial
  CRISPR gRNA sequence
gccttagtgtggaataaaga

SEQ ID NO: 810081 - DNA, 20 bp, Artificial
  CRISPR gRNA sequence
ccttagtgtggaataaagaa

SEQ ID NO: 810082 - DNA, 20 bp, Artificial
  CRISPR gRNA sequence
agtgtggaataaagaagact

SEQ ID NO: 810083 - DNA, 20 bp, Artificial
  CRISPR gRNA sequence
gtgtggaataaagaagactt

SEQ ID NO: 810084 - DNA, 20 bp, Artificial
  CRISPR gRNA sequence
gtgtgaacaatgaaaataca

SEQ ID NO: 810085 - DNA, 20 bp, Artificial
  CRISPR gRNA sequence
tgtgaacaatgaaaatacat

SEQ ID NO: 810086 - DNA, 20 bp, Artificial
  CRISPR gRNA sequence
aaaaggcaagcatagttaca

SEQ ID NO: 810087 - DNA, 20 bp, Artificial
  CRISPR gRNA sequence
caaggcaaacaaatggtcca

SEQ ID NO: 810088 - DNA, 20 bp, Artificial
  CRISPR gRNA sequence
aaaatgtgggatgagggaaa

SEQ ID NO: 810089 - DNA, 20 bp, Artificial
  CRISPR gRNA sequence
gtgccctggagtgactgagc

SEQ ID NO: 810090 - DNA, 20 bp, Artificial
  CRISPR gRNA sequence
tgccctggagtgactgagct

SEQ ID NO: 810091 - DNA, 20 bp, Artificial
  CRISPR gRNA sequence
gagtgactgagctgccccag

SEQ ID NO: 810092 - DNA, 20 bp, Artificial
  CRISPR gRNA sequence
agctgccccagagagagggt

SEQ ID NO: 810093 - DNA, 20 bp, Artificial
  CRISPR gRNA sequence
ccccagagagagggtgggct

SEQ ID NO: 810094 - DNA, 20 bp, Artificial
  CRISPR gRNA sequence
ggagctagtagagagggaaa

SEQ ID NO: 810095 - DNA, 20 bp, Artificial
  CRISPR gRNA sequence
gagctagtagagagggaaat

SEQ ID NO: 810096 - DNA, 20 bp, Artificial
  CRISPR gRNA sequence
gtagagagggaaataatgat

SEQ ID NO: 810097 - DNA, 20 bp, Artificial
  CRISPR gRNA sequence
atgtggaaaaacctgagcaa

SEQ ID NO: 810098 - DNA, 20 bp, Artificial
  CRISPR gRNA sequence
tgtggaaaaacctgagcaaa

SEQ ID NO: 810099 - DNA, 20 bp, Artificial
  CRISPR gRNA sequence
agcaaagaaggcatggaggt

SEQ ID NO: 810100 - DNA, 20 bp, Artificial
  CRISPR gRNA sequence
agagagcatgtggtgaggaa

SEQ ID NO: 810101 - DNA, 20 bp, Artificial
  CRISPR gRNA sequence
atgaagcagaggatccatgt

SEQ ID NO: 810102 - DNA, 20 bp, Artificial
  CRISPR gRNA sequence
ggaaggatgggtaaaaccag

SEQ ID NO: 810103 - DNA, 20 bp, Artificial
  CRISPR gRNA sequence
agaatttctggctgcacaaa

SEQ ID NO: 810104 - DNA, 20 bp, Artificial
  CRISPR gRNA sequence
ctggctgcacaaagatttct

SEQ ID NO: 810105 - DNA, 20 bp, Artificial
  CRISPR gRNA sequence
tggctgcacaaagatttctc

SEQ ID NO: 810106 - DNA, 20 bp, Artificial
  CRISPR gRNA sequence
gctgcacaaagatttctcca

SEQ ID NO: 810107 - DNA, 20 bp, Artificial
  CRISPR gRNA sequence
cacaaagatttctccatctc

SEQ ID NO: 810108 - DNA, 20 bp, Artificial
  CRISPR gRNA sequence
ctccatctccctgatggctg

SEQ ID NO: 810109 - DNA, 20 bp, Artificial
  CRISPR gRNA sequence
tccatctccctgatggctgt

SEQ ID NO: 810110 - DNA, 20 bp, Artificial
  CRISPR gRNA sequence
catctccctgatggctgtat

SEQ ID NO: 810111 - DNA, 20 bp, Artificial
  CRISPR gRNA sequence
cctgatggctgtatttatga

SEQ ID NO: 810112 - DNA, 20 bp, Artificial
  CRISPR gRNA sequence
atggctgtatttatgagtga

SEQ ID NO: 810113 - DNA, 20 bp, Artificial
  CRISPR gRNA sequence
tatttatgagtgatacccta

SEQ ID NO: 810114 - DNA, 20 bp, Artificial
  CRISPR gRNA sequence
atgagtgataccctaggaga

SEQ ID NO: 810115 - DNA, 20 bp, Artificial
  CRISPR gRNA sequence
tgagtgataccctaggagat

SEQ ID NO: 810116 - DNA, 20 bp, Artificial
  CRISPR gRNA sequence
ggagatcctgagctctgatg

SEQ ID NO: 810117 - DNA, 20 bp, Artificial
  CRISPR gRNA sequence
agctctgatgaagaccccac

SEQ ID NO: 810118 - DNA, 20 bp, Artificial
  CRISPR gRNA sequence
tgatgaagaccccacaggtc

SEQ ID NO: 810119 - DNA, 20 bp, Artificial
  CRISPR gRNA sequence
atgaagaccccacaggtctc

SEQ ID NO: 810120 - DNA, 20 bp, Artificial
  CRISPR gRNA sequence
tcccatggttgttgactatt

SEQ ID NO: 810121 - DNA, 20 bp, Artificial
  CRISPR gRNA sequence
ccatggttgttgactattta

SEQ ID NO: 810122 - DNA, 20 bp, Artificial
  CRISPR gRNA sequence
ttgactatttagtaagccat

SEQ ID NO: 810123 - DNA, 20 bp, Artificial
  CRISPR gRNA sequence
actatttagtaagccatgtt

SEQ ID NO: 810124 - DNA, 20 bp, Artificial
  CRISPR gRNA sequence
tttagtaagccatgttggct

SEQ ID NO: 810125 - DNA, 20 bp, Artificial
  CRISPR gRNA sequence
agtaagccatgttggcttcc

SEQ ID NO: 810126 - DNA, 20 bp, Artificial
  CRISPR gRNA sequence
gtaagccatgttggcttcca

SEQ ID NO: 810127 - DNA, 20 bp, Artificial
  CRISPR gRNA sequence
gcttccatgaagagagtgga

SEQ ID NO: 810128 - DNA, 20 bp, Artificial
  CRISPR gRNA sequence
ccatgaagagagtggagtgg

SEQ ID NO: 810129 - DNA, 20 bp, Artificial
  CRISPR gRNA sequence
catgaagagagtggagtggc

SEQ ID NO: 810130 - DNA, 20 bp, Artificial
  CRISPR gRNA sequence
tactccactgttaacttctc

SEQ ID NO: 810131 - DNA, 20 bp, Artificial
  CRISPR gRNA sequence
actccactgttaacttctca

SEQ ID NO: 810132 - DNA, 20 bp, Artificial
  CRISPR gRNA sequence
ctccactgttaacttctcac

SEQ ID NO: 810133 - DNA, 20 bp, Artificial
  CRISPR gRNA sequence
cactgttaacttctcacagc

SEQ ID NO: 810134 - DNA, 20 bp, Artificial
  CRISPR gRNA sequence
ttaacttctcacagcgtaaa

SEQ ID NO: 810135 - DNA, 20 bp, Artificial
  CRISPR gRNA sequence
acttctcacagcgtaaaggc

SEQ ID NO: 810136 - DNA, 20 bp, Artificial
  CRISPR gRNA sequence
ctcacagcgtaaaggcttcc

SEQ ID NO: 810137 - DNA, 20 bp, Artificial
  CRISPR gRNA sequence
tcacagcgtaaaggcttcca

SEQ ID NO: 810138 - DNA, 20 bp, Artificial
  CRISPR gRNA sequence
acagcgtaaaggcttccaga

SEQ ID NO: 810139 - DNA, 20 bp, Artificial
  CRISPR gRNA sequence
ccagagcaatggtcagtctg

SEQ ID NO: 810140 - DNA, 20 bp, Artificial
  CRISPR gRNA sequence
cagagcaatggtcagtctgc

SEQ ID NO: 810141 - DNA, 20 bp, Artificial
  CRISPR gRNA sequence
ccctttcacatctctaccat

SEQ ID NO: 810142 - DNA, 20 bp, Artificial
  CRISPR gRNA sequence
tcacatctctaccatgcaga

SEQ ID NO: 810143 - DNA, 20 bp, Artificial
  CRISPR gRNA sequence
cacatctctaccatgcagaa

SEQ ID NO: 810144 - DNA, 20 bp, Artificial
  CRISPR gRNA sequence
acatctctaccatgcagaat

SEQ ID NO: 810145 - DNA, 20 bp, Artificial
  CRISPR gRNA sequence
taccatgcagaatagaacac

SEQ ID NO: 810146 - DNA, 20 bp, Artificial
  CRISPR gRNA sequence
ccatgcagaatagaacactg

SEQ ID NO: 810147 - DNA, 20 bp, Artificial
  CRISPR gRNA sequence
acataatcagtggtgtaaag

SEQ ID NO: 810148 - DNA, 20 bp, Artificial
  CRISPR gRNA sequence
tttctcaattcatctcatac

SEQ ID NO: 810149 - DNA, 20 bp, Artificial
  CRISPR gRNA sequence
ctcaattcatctcatacagg

SEQ ID NO: 810150 - DNA, 20 bp, Artificial
  CRISPR gRNA sequence
tcaattcatctcatacaggc

SEQ ID NO: 810151 - DNA, 20 bp, Artificial
  CRISPR gRNA sequence
aattcatctcatacaggccc

SEQ ID NO: 810152 - DNA, 20 bp, Artificial
  CRISPR gRNA sequence
atctcatacaggcccctgtt

SEQ ID NO: 810153 - DNA, 20 bp, Artificial
  CRISPR gRNA sequence
atacaggcccctgtttccct

SEQ ID NO: 810154 - DNA, 20 bp, Artificial
  CRISPR gRNA sequence
tttccctggagaggttctta

SEQ ID NO: 810155 - DNA, 20 bp, Artificial
  CRISPR gRNA sequence
ccctggagaggttcttatat

SEQ ID NO: 810156 - DNA, 20 bp, Artificial
  CRISPR gRNA sequence
cctggagaggttcttatata

SEQ ID NO: 810157 - DNA, 20 bp, Artificial
  CRISPR gRNA sequence
gagaggttcttatataagaa

SEQ ID NO: 810158 - DNA, 20 bp, Artificial
  CRISPR gRNA sequence
ttatataagaagcgtctttc

SEQ ID NO: 810159 - DNA, 20 bp, Artificial
  CRISPR gRNA sequence
atataagaagcgtctttcta

SEQ ID NO: 810160 - DNA, 20 bp, Artificial
  CRISPR gRNA sequence
tataagaagcgtctttctag

SEQ ID NO: 810161 - DNA, 20 bp, Artificial
  CRISPR gRNA sequence
tctagaaaactacaattcat

SEQ ID NO: 810162 - DNA, 20 bp, Artificial
  CRISPR gRNA sequence
ctagaaaactacaattcatc

SEQ ID NO: 810163 - DNA, 20 bp, Artificial
  CRISPR gRNA sequence
tagaaaactacaattcatcc

SEQ ID NO: 810164 - DNA, 20 bp, Artificial
  CRISPR gRNA sequence
gaaaactacaattcatccaa

SEQ ID NO: 810165 - DNA, 20 bp, Artificial
  CRISPR gRNA sequence
caattcatccaaagtactgg

SEQ ID NO: 810166 - DNA, 20 bp, Artificial
  CRISPR gRNA sequence
atccaaagtactggcctaca

SEQ ID NO: 810167 - DNA, 20 bp, Artificial
  CRISPR gRNA sequence
gcctacacttaaccaggcag

SEQ ID NO: 810168 - DNA, 20 bp, Artificial
  CRISPR gRNA sequence
cacttaaccaggcaggaaat

SEQ ID NO: 810169 - DNA, 20 bp, Artificial
  CRISPR gRNA sequence
aaccaggcaggaaattccat

SEQ ID NO: 810170 - DNA, 20 bp, Artificial
  CRISPR gRNA sequence
accaggcaggaaattccata

SEQ ID NO: 810171 - DNA, 20 bp, Artificial
  CRISPR gRNA sequence
catataacgaacgacagttg

SEQ ID NO: 810172 - DNA, 20 bp, Artificial
  CRISPR gRNA sequence
aataaacaattccaggggaa

SEQ ID NO: 810173 - DNA, 20 bp, Artificial
  CRISPR gRNA sequence
caggggaaaaaagttctcgt

SEQ ID NO: 810174 - DNA, 20 bp, Artificial
  CRISPR gRNA sequence
tcgtgggattgctcatattt

SEQ ID NO: 810175 - DNA, 20 bp, Artificial
  CRISPR gRNA sequence
gtgggattgctcatatttaa

SEQ ID NO: 810176 - DNA, 20 bp, Artificial
  CRISPR gRNA sequence
ctcatatttaatcctcttta

SEQ ID NO: 810177 - DNA, 20 bp, Artificial
  CRISPR gRNA sequence
atatttaatcctctttagag

SEQ ID NO: 810178 - DNA, 20 bp, Artificial
  CRISPR gRNA sequence
aatcctctttagaggcttta

SEQ ID NO: 810179 - DNA, 20 bp, Artificial
  CRISPR gRNA sequence
atcctctttagaggctttag

SEQ ID NO: 810180 - DNA, 20 bp, Artificial
  CRISPR gRNA sequence
tttagaggctttagctttag

SEQ ID NO: 810181 - DNA, 20 bp, Artificial
  CRISPR gRNA sequence
tagaggctttagctttagta

SEQ ID NO: 810182 - DNA, 20 bp, Artificial
  CRISPR gRNA sequence
agaggctttagctttagtat

SEQ ID NO: 810183 - DNA, 20 bp, Artificial
  CRISPR gRNA sequence
gaggctttagctttagtatg

SEQ ID NO: 810184 - DNA, 20 bp, Artificial
  CRISPR gRNA sequence
tagctttagtatgaattagt

SEQ ID NO: 810185 - DNA, 20 bp, Artificial
  CRISPR gRNA sequence
agctttagtatgaattagtt

SEQ ID NO: 810186 - DNA, 20 bp, Artificial
  CRISPR gRNA sequence
gctttagtatgaattagtta

SEQ ID NO: 810187 - DNA, 20 bp, Artificial
  CRISPR gRNA sequence
tagtatgaattagttagagt

SEQ ID NO: 810188 - DNA, 20 bp, Artificial
  CRISPR gRNA sequence
agtatgaattagttagagtt

SEQ ID NO: 810189 - DNA, 20 bp, Artificial
  CRISPR gRNA sequence
gtatgaattagttagagttc

SEQ ID NO: 810190 - DNA, 20 bp, Artificial
  CRISPR gRNA sequence
gttagagttcatctttcatg

SEQ ID NO: 810191 - DNA, 20 bp, Artificial
  CRISPR gRNA sequence
gagttcatctttcatgaggt

SEQ ID NO: 810192 - DNA, 20 bp, Artificial
  CRISPR gRNA sequence
atctttcatgaggtgagaag

SEQ ID NO: 810193 - DNA, 20 bp, Artificial
  CRISPR gRNA sequence
tcatgaggtgagaagtctgt

SEQ ID NO: 810194 - DNA, 20 bp, Artificial
  CRISPR gRNA sequence
catgaggtgagaagtctgtg

SEQ ID NO: 810195 - DNA, 20 bp, Artificial
  CRISPR gRNA sequence
atgaggtgagaagtctgtgg

SEQ ID NO: 810196 - DNA, 20 bp, Artificial
  CRISPR gRNA sequence
tggtctcaaccatgatataa

SEQ ID NO: 810197 - DNA, 20 bp, Artificial
  CRISPR gRNA sequence
aaccatgatataaagagagg

SEQ ID NO: 810198 - DNA, 20 bp, Artificial
  CRISPR gRNA sequence
aaagaccaacttgcctaatt

SEQ ID NO: 810199 - DNA, 20 bp, Artificial
  CRISPR gRNA sequence
gcctaattcatttttttacc

SEQ ID NO: 810200 - DNA, 20 bp, Artificial
  CRISPR gRNA sequence
cctaattcatttttttacct

SEQ ID NO: 810201 - DNA, 20 bp, Artificial
  CRISPR gRNA sequence
attcatttttttacctgaag

SEQ ID NO: 810202 - DNA, 20 bp, Artificial
  CRISPR gRNA sequence
atttttttacctgaagttgg

SEQ ID NO: 810203 - DNA, 20 bp, Artificial
  CRISPR gRNA sequence
ttttacctgaagttggtcct

SEQ ID NO: 810204 - DNA, 20 bp, Artificial
  CRISPR gRNA sequence
tttacctgaagttggtccta

SEQ ID NO: 810205 - DNA, 20 bp, Artificial
  CRISPR gRNA sequence
ttacctgaagttggtcctaa

SEQ ID NO: 810206 - DNA, 20 bp, Artificial
  CRISPR gRNA sequence
tacctgaagttggtcctaaa

SEQ ID NO: 810207 - DNA, 20 bp, Artificial
  CRISPR gRNA sequence
acctgaagttggtcctaaaa

SEQ ID NO: 810208 - DNA, 20 bp, Artificial
  CRISPR gRNA sequence
cctgaagttggtcctaaaat

SEQ ID NO: 810209 - DNA, 20 bp, Artificial
  CRISPR gRNA sequence
aagttggtcctaaaattgat

SEQ ID NO: 810210 - DNA, 20 bp, Artificial
  CRISPR gRNA sequence
gtcctaaaattgatggattt

SEQ ID NO: 810211 - DNA, 20 bp, Artificial
  CRISPR gRNA sequence
aaattgatggatttctagtt

SEQ ID NO: 810212 - DNA, 20 bp, Artificial
  CRISPR gRNA sequence
atggatttctagtttctttc

SEQ ID NO: 810213 - DNA, 20 bp, Artificial
  CRISPR gRNA sequence
ctagtttctttctttcccct

SEQ ID NO: 810214 - DNA, 20 bp, Artificial
  CRISPR gRNA sequence
tagtttctttctttcccctc

SEQ ID NO: 810215 - DNA, 20 bp, Artificial
  CRISPR gRNA sequence
gtttctttctttcccctccc

SEQ ID NO: 810216 - DNA, 20 bp, Artificial
  CRISPR gRNA sequence
ctttctttcccctccctacc

SEQ ID NO: 810217 - DNA, 20 bp, Artificial
  CRISPR gRNA sequence
tttctttcccctccctacct

SEQ ID NO: 810218 - DNA, 20 bp, Artificial
  CRISPR gRNA sequence
tctttcccctccctacctcc

SEQ ID NO: 810219 - DNA, 20 bp, Artificial
  CRISPR gRNA sequence
ctttcccctccctacctcct

SEQ ID NO: 810220 - DNA, 20 bp, Artificial
  CRISPR gRNA sequence
tttcccctccctacctcctc

SEQ ID NO: 810221 - DNA, 20 bp, Artificial
  CRISPR gRNA sequence
tcccctccctacctcctctc

SEQ ID NO: 810222 - DNA, 20 bp, Artificial
  CRISPR gRNA sequence
cccctccctacctcctctcc

SEQ ID NO: 810223 - DNA, 20 bp, Artificial
  CRISPR gRNA sequence
ccctccctacctcctctccc

SEQ ID NO: 810224 - DNA, 20 bp, Artificial
  CRISPR gRNA sequence
cctacctcctctcccctcct

SEQ ID NO: 810225 - DNA, 20 bp, Artificial
  CRISPR gRNA sequence
cctcctctcccctcctctcc

SEQ ID NO: 810226 - DNA, 20 bp, Artificial
  CRISPR gRNA sequence
ctctcccctcctctcccctt

SEQ ID NO: 810227 - DNA, 20 bp, Artificial
  CRISPR gRNA sequence
tcccctcctctcccctttcc

SEQ ID NO: 810228 - DNA, 20 bp, Artificial
  CRISPR gRNA sequence
ccctcctctcccctttcctt

SEQ ID NO: 810229 - DNA, 20 bp, Artificial
  CRISPR gRNA sequence
ctctcccctttccttttctt

SEQ ID NO: 810230 - DNA, 20 bp, Artificial
  CRISPR gRNA sequence
tcccctttccttttcttttt

SEQ ID NO: 810231 - DNA, 20 bp, Artificial
  CRISPR gRNA sequence
ccctttccttttcttttttg

SEQ ID NO: 810232 - DNA, 20 bp, Artificial
  CRISPR gRNA sequence
tccttttcttttttggagac

SEQ ID NO: 810233 - DNA, 20 bp, Artificial
  CRISPR gRNA sequence
ccttttcttttttggagaca

SEQ ID NO: 810234 - DNA, 20 bp, Artificial
  CRISPR gRNA sequence
cttttcttttttggagacag

SEQ ID NO: 810235 - DNA, 20 bp, Artificial
  CRISPR gRNA sequence
ttcttttttggagacagagt

SEQ ID NO: 810236 - DNA, 20 bp, Artificial
  CRISPR gRNA sequence
tcttttttggagacagagtc

SEQ ID NO: 810237 - DNA, 20 bp, Artificial
  CRISPR gRNA sequence
cttttttggagacagagtct

SEQ ID NO: 810238 - DNA, 20 bp, Artificial
  CRISPR gRNA sequence
ttttttggagacagagtctc

SEQ ID NO: 810239 - DNA, 20 bp, Artificial
  CRISPR gRNA sequence
ttttggagacagagtctcac

SEQ ID NO: 810240 - DNA, 20 bp, Artificial
  CRISPR gRNA sequence
tttggagacagagtctcact

SEQ ID NO: 810241 - DNA, 20 bp, Artificial
  CRISPR gRNA sequence
ttggagacagagtctcactc

SEQ ID NO: 810242 - DNA, 20 bp, Artificial
  CRISPR gRNA sequence
tggagacagagtctcactcg

SEQ ID NO: 810243 - DNA, 20 bp, Artificial
  CRISPR gRNA sequence
ggagacagagtctcactcgg

SEQ ID NO: 810244 - DNA, 20 bp, Artificial
  CRISPR gRNA sequence
gagacagagtctcactcggt

SEQ ID NO: 810245 - DNA, 20 bp, Artificial
  CRISPR gRNA sequence
actcggttgcccaggctgga

SEQ ID NO: 810246 - DNA, 20 bp, Artificial
  CRISPR gRNA sequence
ggttgcccaggctggagtgg

SEQ ID NO: 810247 - DNA, 20 bp, Artificial
  CRISPR gRNA sequence
cccaggctggagtggagtac

SEQ ID NO: 810248 - DNA, 20 bp, Artificial
  CRISPR gRNA sequence
gagtggagtacaatggcaca

SEQ ID NO: 810249 - DNA, 20 bp, Artificial
  CRISPR gRNA sequence
tagctcactgtaacctcaat

SEQ ID NO: 810250 - DNA, 20 bp, Artificial
  CRISPR gRNA sequence
actgtaacctcaatctactg

SEQ ID NO: 810251 - DNA, 20 bp, Artificial
  CRISPR gRNA sequence
taacctcaatctactgggct

SEQ ID NO: 810252 - DNA, 20 bp, Artificial
  CRISPR gRNA sequence
aatctactgggctcaagtga

SEQ ID NO: 810253 - DNA, 20 bp, Artificial
  CRISPR gRNA sequence
ctgggctcaagtgatcctcc

SEQ ID NO: 810254 - DNA, 20 bp, Artificial
  CRISPR gRNA sequence
ggctcaagtgatcctcctgc

SEQ ID NO: 810255 - DNA, 20 bp, Artificial
  CRISPR gRNA sequence
aagtgatcctcctgccttgg

SEQ ID NO: 810256 - DNA, 20 bp, Artificial
  CRISPR gRNA sequence
ctgccttggcctcccaaagt

SEQ ID NO: 810257 - DNA, 20 bp, Artificial
  CRISPR gRNA sequence
ccttggcctcccaaagtgct

SEQ ID NO: 810258 - DNA, 20 bp, Artificial
  CRISPR gRNA sequence
ggcctcccaaagtgctggga

SEQ ID NO: 810259 - DNA, 20 bp, Artificial
  CRISPR gRNA sequence
gcctcccaaagtgctgggat

SEQ ID NO: 810260 - DNA, 20 bp, Artificial
  CRISPR gRNA sequence
ccaaagtgctgggattacag

SEQ ID NO: 810261 - DNA, 20 bp, Artificial
  CRISPR gRNA sequence
ggattacagacaagaaccac

SEQ ID NO: 810262 - DNA, 20 bp, Artificial
  CRISPR gRNA sequence
cagacaagaaccaccatgcc

SEQ ID NO: 810263 - DNA, 20 bp, Artificial
  CRISPR gRNA sequence
taatgttttgatttcagtta

SEQ ID NO: 810264 - DNA, 20 bp, Artificial
  CRISPR gRNA sequence
atgttttgatttcagttaag

SEQ ID NO: 810265 - DNA, 20 bp, Artificial
  CRISPR gRNA sequence
tgatttcagttaagatcctt

SEQ ID NO: 810266 - DNA, 20 bp, Artificial
  CRISPR gRNA sequence
gatttcagttaagatcctta

SEQ ID NO: 810267 - DNA, 20 bp, Artificial
  CRISPR gRNA sequence
atttcagttaagatccttag

SEQ ID NO: 810268 - DNA, 20 bp, Artificial
  CRISPR gRNA sequence
cagttaagatccttagcatg

SEQ ID NO: 810269 - DNA, 20 bp, Artificial
  CRISPR gRNA sequence
agttaagatccttagcatga

SEQ ID NO: 810270 - DNA, 20 bp, Artificial
  CRISPR gRNA sequence
agatccttagcatgactcct

SEQ ID NO: 810271 - DNA, 20 bp, Artificial
  CRISPR gRNA sequence
agcatgactcctctctttcc

SEQ ID NO: 810272 - DNA, 20 bp, Artificial
  CRISPR gRNA sequence
gcatgactcctctctttcct

SEQ ID NO: 810273 - DNA, 20 bp, Artificial
  CRISPR gRNA sequence
ctctctttccttctaaacta

SEQ ID NO: 810274 - DNA, 20 bp, Artificial
  CRISPR gRNA sequence
tctttccttctaaactaata

SEQ ID NO: 810275 - DNA, 20 bp, Artificial
  CRISPR gRNA sequence
tttccttctaaactaataat

SEQ ID NO: 810276 - DNA, 20 bp, Artificial
  CRISPR gRNA sequence
tccttctaaactaataattt

SEQ ID NO: 810277 - DNA, 20 bp, Artificial
  CRISPR gRNA sequence
ccttctaaactaataattta

SEQ ID NO: 810278 - DNA, 20 bp, Artificial
  CRISPR gRNA sequence
cttctaaactaataatttag

SEQ ID NO: 810279 - DNA, 20 bp, Artificial
  CRISPR gRNA sequence
ctaaactaataatttagtta

SEQ ID NO: 810280 - DNA, 20 bp, Artificial
  CRISPR gRNA sequence
taaactaataatttagttag

SEQ ID NO: 810281 - DNA, 20 bp, Artificial
  CRISPR gRNA sequence
aactaataatttagttagaa

SEQ ID NO: 810282 - DNA, 20 bp, Artificial
  CRISPR gRNA sequence
ataatttagttagaaggaag

SEQ ID NO: 810283 - DNA, 20 bp, Artificial
  CRISPR gRNA sequence
agttagaaggaagttgggct

SEQ ID NO: 810284 - DNA, 20 bp, Artificial
  CRISPR gRNA sequence
gttagaaggaagttgggcta

SEQ ID NO: 810285 - DNA, 20 bp, Artificial
  CRISPR gRNA sequence
gaaggaagttgggctaactt

SEQ ID NO: 810286 - DNA, 20 bp, Artificial
  CRISPR gRNA sequence
ggctaactttagtgttggca

SEQ ID NO: 810287 - DNA, 20 bp, Artificial
  CRISPR gRNA sequence
actttagtgttggcattggg

SEQ ID NO: 810288 - DNA, 20 bp, Artificial
  CRISPR gRNA sequence
tagtgttggcattgggtagt

SEQ ID NO: 810289 - DNA, 20 bp, Artificial
  CRISPR gRNA sequence
agtgttggcattgggtagta

SEQ ID NO: 810290 - DNA, 20 bp, Artificial
  CRISPR gRNA sequence
gtgttggcattgggtagtaa

SEQ ID NO: 810291 - DNA, 20 bp, Artificial
  CRISPR gRNA sequence
gcattgggtagtaaattgtg

SEQ ID NO: 810292 - DNA, 20 bp, Artificial
  CRISPR gRNA sequence
ggtagtaaattgtggatagg

SEQ ID NO: 810293 - DNA, 20 bp, Artificial
  CRISPR gRNA sequence
tggataggtagggaagtggg

SEQ ID NO: 810294 - DNA, 20 bp, Artificial
  CRISPR gRNA sequence
gctgcctctgaaaactgtat

SEQ ID NO: 810295 - DNA, 20 bp, Artificial
  CRISPR gRNA sequence
cctctgaaaactgtatcagg

SEQ ID NO: 810296 - DNA, 20 bp, Artificial
  CRISPR gRNA sequence
tgaaaactgtatcagggaag

SEQ ID NO: 810297 - DNA, 20 bp, Artificial
  CRISPR gRNA sequence
aaaactgtatcagggaagaa

SEQ ID NO: 810298 - DNA, 20 bp, Artificial
  CRISPR gRNA sequence
tatcagggaagaattttttc

SEQ ID NO: 810299 - DNA, 20 bp, Artificial
  CRISPR gRNA sequence
tttccagaagaaaataccag

SEQ ID NO: 810300 - DNA, 20 bp, Artificial
  CRISPR gRNA sequence
ttccagaagaaaataccagg

SEQ ID NO: 810301 - DNA, 20 bp, Artificial
  CRISPR gRNA sequence
tccagaagaaaataccagga

SEQ ID NO: 810302 - DNA, 20 bp, Artificial
  CRISPR gRNA sequence
ccagaagaaaataccaggaa

SEQ ID NO: 810303 - DNA, 20 bp, Artificial
  CRISPR gRNA sequence
cagaagaaaataccaggaaa

SEQ ID NO: 810304 - DNA, 20 bp, Artificial
  CRISPR gRNA sequence
tgatgagatgggtatttagt

SEQ ID NO: 810305 - DNA, 20 bp, Artificial
  CRISPR gRNA sequence
agtcactgcaaagttcttgg

SEQ ID NO: 810306 - DNA, 20 bp, Artificial
  CRISPR gRNA sequence
gtcactgcaaagttcttgga

SEQ ID NO: 810307 - DNA, 20 bp, Artificial
  CRISPR gRNA sequence
caaagttcttggagtctggt

SEQ ID NO: 810308 - DNA, 20 bp, Artificial
  CRISPR gRNA sequence
ttggagtctggtctgtggat

SEQ ID NO: 810309 - DNA, 20 bp, Artificial
  CRISPR gRNA sequence
ggagtctggtctgtggatca

SEQ ID NO: 810310 - DNA, 20 bp, Artificial
  CRISPR gRNA sequence
gagtctggtctgtggatcag

SEQ ID NO: 810311 - DNA, 20 bp, Artificial
  CRISPR gRNA sequence
gtctgtggatcagtgtcact

SEQ ID NO: 810312 - DNA, 20 bp, Artificial
  CRISPR gRNA sequence
tggatcagtgtcactccatg

SEQ ID NO: 810313 - DNA, 20 bp, Artificial
  CRISPR gRNA sequence
catgaaaaaattaattttaa

SEQ ID NO: 810314 - DNA, 20 bp, Artificial
  CRISPR gRNA sequence
attttaatttggcataaagc

SEQ ID NO: 810315 - DNA, 20 bp, Artificial
  CRISPR gRNA sequence
taatttggcataaagcatca

SEQ ID NO: 810316 - DNA, 20 bp, Artificial
  CRISPR gRNA sequence
aatttggcataaagcatcag

SEQ ID NO: 810317 - DNA, 20 bp, Artificial
  CRISPR gRNA sequence
atttggcataaagcatcaga

SEQ ID NO: 810318 - DNA, 20 bp, Artificial
  CRISPR gRNA sequence
ggcataaagcatcagatatc

SEQ ID NO: 810319 - DNA, 20 bp, Artificial
  CRISPR gRNA sequence
gcataaagcatcagatatct

SEQ ID NO: 810320 - DNA, 20 bp, Artificial
  CRISPR gRNA sequence
tgatgcctcaactcatacca

SEQ ID NO: 810321 - DNA, 20 bp, Artificial
  CRISPR gRNA sequence
atgcctcaactcataccatg

SEQ ID NO: 810322 - DNA, 20 bp, Artificial
  CRISPR gRNA sequence
aactcataccatgtctgcct

SEQ ID NO: 810323 - DNA, 20 bp, Artificial
  CRISPR gRNA sequence
ataccatgtctgcctcaccc

SEQ ID NO: 810324 - DNA, 20 bp, Artificial
  CRISPR gRNA sequence
cctcaccccaactgtacttg

SEQ ID NO: 810325 - DNA, 20 bp, Artificial
  CRISPR gRNA sequence
accccaactgtacttgatgg

SEQ ID NO: 810326 - DNA, 20 bp, Artificial
  CRISPR gRNA sequence
tacttgatggtggtagttct

SEQ ID NO: 810327 - DNA, 20 bp, Artificial
  CRISPR gRNA sequence
gatggtggtagttctgtgca

SEQ ID NO: 810328 - DNA, 20 bp, Artificial
  CRISPR gRNA sequence
atggtggtagttctgtgcaa

SEQ ID NO: 810329 - DNA, 20 bp, Artificial
  CRISPR gRNA sequence
tgtgcaaggtctaactcatt

SEQ ID NO: 810330 - DNA, 20 bp, Artificial
  CRISPR gRNA sequence
tgcaaggtctaactcatttc

SEQ ID NO: 810331 - DNA, 20 bp, Artificial
  CRISPR gRNA sequence
actcatttcctcctgacaac

SEQ ID NO: 810332 - DNA, 20 bp, Artificial
  CRISPR gRNA sequence
atttcctcctgacaacctcc

SEQ ID NO: 810333 - DNA, 20 bp, Artificial
  CRISPR gRNA sequence
cctcctgacaacctcctcaa

SEQ ID NO: 810334 - DNA, 20 bp, Artificial
  CRISPR gRNA sequence
ctcctgacaacctcctcaag

SEQ ID NO: 810335 - DNA, 20 bp, Artificial
  CRISPR gRNA sequence
ctgacaacctcctcaagcat

SEQ ID NO: 810336 - DNA, 20 bp, Artificial
  CRISPR gRNA sequence
acaacctcctcaagcatgtt

SEQ ID NO: 810337 - DNA, 20 bp, Artificial
  CRISPR gRNA sequence
ctcaagcatgttctacgtct

SEQ ID NO: 810338 - DNA, 20 bp, Artificial
  CRISPR gRNA sequence
aagcatgttctacgtctgta

SEQ ID NO: 810339 - DNA, 20 bp, Artificial
  CRISPR gRNA sequence
tacgtctgtaccagggctat

SEQ ID NO: 810340 - DNA, 20 bp, Artificial
  CRISPR gRNA sequence
cgtctgtaccagggctatcc

SEQ ID NO: 810341 - DNA, 20 bp, Artificial
  CRISPR gRNA sequence
taccagggctatcccagtgc

SEQ ID NO: 810342 - DNA, 20 bp, Artificial
  CRISPR gRNA sequence
tcccagtgctgcaggttggc

SEQ ID NO: 810343 - DNA, 20 bp, Artificial
  CRISPR gRNA sequence
caggttggcccctctcacca

SEQ ID NO: 810344 - DNA, 20 bp, Artificial
  CRISPR gRNA sequence
gcccctctcaccattacttc

SEQ ID NO: 810345 - DNA, 20 bp, Artificial
  CRISPR gRNA sequence
tcaccattacttctaatgac

SEQ ID NO: 810346 - DNA, 20 bp, Artificial
  CRISPR gRNA sequence
accattacttctaatgactc

SEQ ID NO: 810347 - DNA, 20 bp, Artificial
  CRISPR gRNA sequence
cttctaatgactcacgtata

SEQ ID NO: 810348 - DNA, 20 bp, Artificial
  CRISPR gRNA sequence
ctaatgactcacgtatagaa

SEQ ID NO: 810349 - DNA, 20 bp, Artificial
  CRISPR gRNA sequence
taatgactcacgtatagaag

SEQ ID NO: 810350 - DNA, 20 bp, Artificial
  CRISPR gRNA sequence
atgactcacgtatagaagtt

SEQ ID NO: 810351 - DNA, 20 bp, Artificial
  CRISPR gRNA sequence
acgtatagaagttcactcaa

SEQ ID NO: 810352 - DNA, 20 bp, Artificial
  CRISPR gRNA sequence
actcaaccccacacatttag

SEQ ID NO: 810353 - DNA, 20 bp, Artificial
  CRISPR gRNA sequence
aaccccacacatttaggctc

SEQ ID NO: 810354 - DNA, 20 bp, Artificial
  CRISPR gRNA sequence
aggctctgctgaatcaaagg

SEQ ID NO: 810355 - DNA, 20 bp, Artificial
  CRISPR gRNA sequence
ggctctgctgaatcaaaggt

SEQ ID NO: 810356 - DNA, 20 bp, Artificial
  CRISPR gRNA sequence
tgctgaatcaaaggtctggc

SEQ ID NO: 810357 - DNA, 20 bp, Artificial
  CRISPR gRNA sequence
ctgaatcaaaggtctggctt

SEQ ID NO: 810358 - DNA, 20 bp, Artificial
  CRISPR gRNA sequence
aatcaaaggtctggcttcct

SEQ ID NO: 810359 - DNA, 20 bp, Artificial
  CRISPR gRNA sequence
gcttcctacggggaattcta

SEQ ID NO: 810360 - DNA, 20 bp, Artificial
  CRISPR gRNA sequence
cctacggggaattctagcag

SEQ ID NO: 810361 - DNA, 20 bp, Artificial
  CRISPR gRNA sequence
ctacggggaattctagcagg

SEQ ID NO: 810362 - DNA, 20 bp, Artificial
  CRISPR gRNA sequence
cggggaattctagcagggga

SEQ ID NO: 810363 - DNA, 20 bp, Artificial
  CRISPR gRNA sequence
tagcaggggatactctgctt

SEQ ID NO: 810364 - DNA, 20 bp, Artificial
  CRISPR gRNA sequence
gcaggggatactctgcttgt

SEQ ID NO: 810365 - DNA, 20 bp, Artificial
  CRISPR gRNA sequence
tgcttgttctactgcatcta

SEQ ID NO: 810366 - DNA, 20 bp, Artificial
  CRISPR gRNA sequence
cttgttctactgcatctaaa

SEQ ID NO: 810367 - DNA, 20 bp, Artificial
  CRISPR gRNA sequence
gttctactgcatctaaagct

SEQ ID NO: 810368 - DNA, 20 bp, Artificial
  CRISPR gRNA sequence
ttctactgcatctaaagctc

SEQ ID NO: 810369 - DNA, 20 bp, Artificial
  CRISPR gRNA sequence
tactgcatctaaagctctgc

SEQ ID NO: 810370 - DNA, 20 bp, Artificial
  CRISPR gRNA sequence
ctgcatctaaagctctgcta

SEQ ID NO: 810371 - DNA, 20 bp, Artificial
  CRISPR gRNA sequence
catctaaagctctgctactg

SEQ ID NO: 810372 - DNA, 20 bp, Artificial
  CRISPR gRNA sequence
aagctctgctactggcctgg

SEQ ID NO: 810373 - DNA, 20 bp, Artificial
  CRISPR gRNA sequence
tgctactggcctggccacct

SEQ ID NO: 810374 - DNA, 20 bp, Artificial
  CRISPR gRNA sequence
ctactggcctggccaccttg

SEQ ID NO: 810375 - DNA, 20 bp, Artificial
  CRISPR gRNA sequence
ctggcctggccaccttgagc

SEQ ID NO: 810376 - DNA, 20 bp, Artificial
  CRISPR gRNA sequence
gcctggccaccttgagctct

SEQ ID NO: 810377 - DNA, 20 bp, Artificial
  CRISPR gRNA sequence
gccaccttgagctcttaata

SEQ ID NO: 810378 - DNA, 20 bp, Artificial
  CRISPR gRNA sequence
gagctcttaatattggcaga

SEQ ID NO: 810379 - DNA, 20 bp, Artificial
  CRISPR gRNA sequence
agctcttaatattggcagac

SEQ ID NO: 810380 - DNA, 20 bp, Artificial
  CRISPR gRNA sequence
ttaatattggcagaccagtg

SEQ ID NO: 810381 - DNA, 20 bp, Artificial
  CRISPR gRNA sequence
aatattggcagaccagtgag

SEQ ID NO: 810382 - DNA, 20 bp, Artificial
  CRISPR gRNA sequence
atattggcagaccagtgagc

SEQ ID NO: 810383 - DNA, 20 bp, Artificial
  CRISPR gRNA sequence
gcagaccagtgagcaaagaa

SEQ ID NO: 810384 - DNA, 20 bp, Artificial
  CRISPR gRNA sequence
ccatactggtggagaaatca

SEQ ID NO: 810385 - DNA, 20 bp, Artificial
  CRISPR gRNA sequence
gtggagaaatcaatcttgat

SEQ ID NO: 810386 - DNA, 20 bp, Artificial
  CRISPR gRNA sequence
gattatcatgaaaatcttga

SEQ ID NO: 810387 - DNA, 20 bp, Artificial
  CRISPR gRNA sequence
attatcatgaaaatcttgaa

SEQ ID NO: 810388 - DNA, 20 bp, Artificial
  CRISPR gRNA sequence
tcatgaaaatcttgaacact

SEQ ID NO: 810389 - DNA, 20 bp, Artificial
  CRISPR gRNA sequence
gaacactgctacataatgga

SEQ ID NO: 810390 - DNA, 20 bp, Artificial
  CRISPR gRNA sequence
aacactgctacataatggag

SEQ ID NO: 810391 - DNA, 20 bp, Artificial
  CRISPR gRNA sequence
ctacataatggagacaagga

SEQ ID NO: 810392 - DNA, 20 bp, Artificial
  CRISPR gRNA sequence
cataatggagacaaggaaga

SEQ ID NO: 810393 - DNA, 20 bp, Artificial
  CRISPR gRNA sequence
gaactcaggggtccgctgat

SEQ ID NO: 810394 - DNA, 20 bp, Artificial
  CRISPR gRNA sequence
aggggtccgctgattcactg

SEQ ID NO: 810395 - DNA, 20 bp, Artificial
  CRISPR gRNA sequence
attcactggttctttttact

SEQ ID NO: 810396 - DNA, 20 bp, Artificial
  CRISPR gRNA sequence
actggttctttttacttcca

SEQ ID NO: 810397 - DNA, 20 bp, Artificial
  CRISPR gRNA sequence
gttctttttacttccatatc

SEQ ID NO: 810398 - DNA, 20 bp, Artificial
  CRISPR gRNA sequence
tttttacttccatatccagt

SEQ ID NO: 810399 - DNA, 20 bp, Artificial
  CRISPR gRNA sequence
tttacttccatatccagtga

SEQ ID NO: 810400 - DNA, 20 bp, Artificial
  CRISPR gRNA sequence
ttacttccatatccagtgat

SEQ ID NO: 810401 - DNA, 20 bp, Artificial
  CRISPR gRNA sequence
tacttccatatccagtgata

SEQ ID NO: 810402 - DNA, 20 bp, Artificial
  CRISPR gRNA sequence
acttccatatccagtgataa

SEQ ID NO: 810403 - DNA, 20 bp, Artificial
  CRISPR gRNA sequence
cttccatatccagtgataat

SEQ ID NO: 810404 - DNA, 20 bp, Artificial
  CRISPR gRNA sequence
ccatatccagtgataatgaa

SEQ ID NO: 810405 - DNA, 20 bp, Artificial
  CRISPR gRNA sequence
catatccagtgataatgaaa

SEQ ID NO: 810406 - DNA, 20 bp, Artificial
  CRISPR gRNA sequence
gcaacaaccccagtctgtta

SEQ ID NO: 810407 - DNA, 20 bp, Artificial
  CRISPR gRNA sequence
caacaaccccagtctgttaa

SEQ ID NO: 810408 - DNA, 20 bp, Artificial
  CRISPR gRNA sequence
ttaagggcatgctgatcaaa

SEQ ID NO: 810409 - DNA, 20 bp, Artificial
  CRISPR gRNA sequence
agggcatgctgatcaaaagc

SEQ ID NO: 810410 - DNA, 20 bp, Artificial
  CRISPR gRNA sequence
atcaaaagctcagatctctt

SEQ ID NO: 810411 - DNA, 20 bp, Artificial
  CRISPR gRNA sequence
agatctcttagggtcgttaa

SEQ ID NO: 810412 - DNA, 20 bp, Artificial
  CRISPR gRNA sequence
ttagggtcgttaagtctggg

SEQ ID NO: 810413 - DNA, 20 bp, Artificial
  CRISPR gRNA sequence
agggtcgttaagtctgggtc

SEQ ID NO: 810414 - DNA, 20 bp, Artificial
  CRISPR gRNA sequence
gggtcgttaagtctgggtca

SEQ ID NO: 810415 - DNA, 20 bp, Artificial
  CRISPR gRNA sequence
agtctgggtcaccctatcag

SEQ ID NO: 810416 - DNA, 20 bp, Artificial
  CRISPR gRNA sequence
ggtcaccctatcaggcaaag

SEQ ID NO: 810417 - DNA, 20 bp, Artificial
  CRISPR gRNA sequence
tcaggcaaagaaaccattcc

SEQ ID NO: 810418 - DNA, 20 bp, Artificial
  CRISPR gRNA sequence
catctggggtgttaggtgag

SEQ ID NO: 810419 - DNA, 20 bp, Artificial
  CRISPR gRNA sequence
gggtgttaggtgagggaaat

SEQ ID NO: 810420 - DNA, 20 bp, Artificial
  CRISPR gRNA sequence
ggtgagggaaatctggaatg

SEQ ID NO: 810421 - DNA, 20 bp, Artificial
  CRISPR gRNA sequence
gaatgtatggtggatgagtg

SEQ ID NO: 810422 - DNA, 20 bp, Artificial
  CRISPR gRNA sequence
tggcttgggatccacagcag

SEQ ID NO: 810423 - DNA, 20 bp, Artificial
  CRISPR gRNA sequence
gggatccacagcagcagcag

SEQ ID NO: 810424 - DNA, 20 bp, Artificial
  CRISPR gRNA sequence
ggatccacagcagcagcagg

SEQ ID NO: 810425 - DNA, 20 bp, Artificial
  CRISPR gRNA sequence
cagcttgttccacaaactgg

SEQ ID NO: 810426 - DNA, 20 bp, Artificial
  CRISPR gRNA sequence
gttccacaaactggtgtata

SEQ ID NO: 810427 - DNA, 20 bp, Artificial
  CRISPR gRNA sequence
ttccacaaactggtgtatat

SEQ ID NO: 810428 - DNA, 20 bp, Artificial
  CRISPR gRNA sequence
cacaaactggtgtatattaa

SEQ ID NO: 810429 - DNA, 20 bp, Artificial
  CRISPR gRNA sequence
gtgtatattaaatcttctgc

SEQ ID NO: 810430 - DNA, 20 bp, Artificial
  CRISPR gRNA sequence
aatcttctgcagagattgtg

SEQ ID NO: 810431 - DNA, 20 bp, Artificial
  CRISPR gRNA sequence
ctgcagagattgtggctgcc

SEQ ID NO: 810432 - DNA, 20 bp, Artificial
  CRISPR gRNA sequence
tgcagagattgtggctgcct

SEQ ID NO: 810433 - DNA, 20 bp, Artificial
  CRISPR gRNA sequence
cagagattgtggctgcctcc

SEQ ID NO: 810434 - DNA, 20 bp, Artificial
  CRISPR gRNA sequence
tggctgcctcccagctggaa

SEQ ID NO: 810435 - DNA, 20 bp, Artificial
  CRISPR gRNA sequence
cctcccagctggaaggctca

SEQ ID NO: 810436 - DNA, 20 bp, Artificial
  CRISPR gRNA sequence
ccagctggaaggctcagtgg

SEQ ID NO: 810437 - DNA, 20 bp, Artificial
  CRISPR gRNA sequence
gaaggctcagtggcagagct

SEQ ID NO: 810438 - DNA, 20 bp, Artificial
  CRISPR gRNA sequence
agtggcagagctgacttaat

SEQ ID NO: 810439 - DNA, 20 bp, Artificial
  CRISPR gRNA sequence
acttaatgaagggcatgagt

SEQ ID NO: 810440 - DNA, 20 bp, Artificial
  CRISPR gRNA sequence
aatgaagggcatgagtggat

SEQ ID NO: 810441 - DNA, 20 bp, Artificial
  CRISPR gRNA sequence
atgaagggcatgagtggatt

SEQ ID NO: 810442 - DNA, 20 bp, Artificial
  CRISPR gRNA sequence
gaacagtacaattggggact

SEQ ID NO: 810443 - DNA, 20 bp, Artificial
  CRISPR gRNA sequence
aacagtacaattggggactg

SEQ ID NO: 810444 - DNA, 20 bp, Artificial
  CRISPR gRNA sequence
gggactgtgcagtcctgcct

SEQ ID NO: 810445 - DNA, 20 bp, Artificial
  CRISPR gRNA sequence
tgcagtcctgccttatttcc

SEQ ID NO: 810446 - DNA, 20 bp, Artificial
  CRISPR gRNA sequence
ccttatttcctctcagcctc

SEQ ID NO: 810447 - DNA, 20 bp, Artificial
  CRISPR gRNA sequence
atttcctctcagcctcacct

SEQ ID NO: 810448 - DNA, 20 bp, Artificial
  CRISPR gRNA sequence
tttcctctcagcctcacctt

SEQ ID NO: 810449 - DNA, 20 bp, Artificial
  CRISPR gRNA sequence
cctctcagcctcacctttca

SEQ ID NO: 810450 - DNA, 20 bp, Artificial
  CRISPR gRNA sequence
ctctcagcctcacctttcac

SEQ ID NO: 810451 - DNA, 20 bp, Artificial
  CRISPR gRNA sequence
tcagcctcacctttcacttc

SEQ ID NO: 810452 - DNA, 20 bp, Artificial
  CRISPR gRNA sequence
agcctcacctttcacttcag

SEQ ID NO: 810453 - DNA, 20 bp, Artificial
  CRISPR gRNA sequence
acctttcacttcagccagct

SEQ ID NO: 810454 - DNA, 20 bp, Artificial
  CRISPR gRNA sequence
tcacttcagccagctggggt

SEQ ID NO: 810455 - DNA, 20 bp, Artificial
  CRISPR gRNA sequence
cacttcagccagctggggta

SEQ ID NO: 810456 - DNA, 20 bp, Artificial
  CRISPR gRNA sequence
acttcagccagctggggtag

SEQ ID NO: 810457 - DNA, 20 bp, Artificial
  CRISPR gRNA sequence
cagccagctggggtagaatt

SEQ ID NO: 810458 - DNA, 20 bp, Artificial
  CRISPR gRNA sequence
agccagctggggtagaattc

SEQ ID NO: 810459 - DNA, 20 bp, Artificial
  CRISPR gRNA sequence
gggtagaattctagttaggc

SEQ ID NO: 810460 - DNA, 20 bp, Artificial
  CRISPR gRNA sequence
tagttaggcttacactcact

SEQ ID NO: 810461 - DNA, 20 bp, Artificial
  CRISPR gRNA sequence
gttaggcttacactcacttc

SEQ ID NO: 810462 - DNA, 20 bp, Artificial
  CRISPR gRNA sequence
ggcttacactcacttcaagg

SEQ ID NO: 810463 - DNA, 20 bp, Artificial
  CRISPR gRNA sequence
acactcacttcaaggtcagt

SEQ ID NO: 810464 - DNA, 20 bp, Artificial
  CRISPR gRNA sequence
cactcacttcaaggtcagta

SEQ ID NO: 810465 - DNA, 20 bp, Artificial
  CRISPR gRNA sequence
acttcaaggtcagtaattca

SEQ ID NO: 810466 - DNA, 20 bp, Artificial
  CRISPR gRNA sequence
caaggtcagtaattcacctc

SEQ ID NO: 810467 - DNA, 20 bp, Artificial
  CRISPR gRNA sequence
aaggtcagtaattcacctca

SEQ ID NO: 810468 - DNA, 20 bp, Artificial
  CRISPR gRNA sequence
acctcaaattggatactttt

SEQ ID NO: 810469 - DNA, 20 bp, Artificial
  CRISPR gRNA sequence
aaattggatacttttctttc

SEQ ID NO: 810470 - DNA, 20 bp, Artificial
  CRISPR gRNA sequence
gatacttttctttctgccct

SEQ ID NO: 810471 - DNA, 20 bp, Artificial
  CRISPR gRNA sequence
ttctttctgccctgcgactt

SEQ ID NO: 810472 - DNA, 20 bp, Artificial
  CRISPR gRNA sequence
tctttctgccctgcgacttt

SEQ ID NO: 810473 - DNA, 20 bp, Artificial
  CRISPR gRNA sequence
ctttctgccctgcgactttt

SEQ ID NO: 810474 - DNA, 20 bp, Artificial
  CRISPR gRNA sequence
tttctgccctgcgacttttc

SEQ ID NO: 810475 - DNA, 20 bp, Artificial
  CRISPR gRNA sequence
tctgccctgcgacttttctg

SEQ ID NO: 810476 - DNA, 20 bp, Artificial
  CRISPR gRNA sequence
ctgccctgcgacttttctga

SEQ ID NO: 810477 - DNA, 20 bp, Artificial
  CRISPR gRNA sequence
tgccctgcgacttttctgat

SEQ ID NO: 810478 - DNA, 20 bp, Artificial
  CRISPR gRNA sequence
ccctgcgacttttctgatgc

SEQ ID NO: 810479 - DNA, 20 bp, Artificial
  CRISPR gRNA sequence
cgacttttctgatgctacgg

SEQ ID NO: 810480 - DNA, 20 bp, Artificial
  CRISPR gRNA sequence
ttctgatgctacggatactg

SEQ ID NO: 810481 - DNA, 20 bp, Artificial
  CRISPR gRNA sequence
tctgatgctacggatactgg

SEQ ID NO: 810482 - DNA, 20 bp, Artificial
  CRISPR gRNA sequence
ctgatgctacggatactggg

SEQ ID NO: 810483 - DNA, 20 bp, Artificial
  CRISPR gRNA sequence
tgatgctacggatactgggg

SEQ ID NO: 810484 - DNA, 20 bp, Artificial
  CRISPR gRNA sequence
atgctacggatactggggaa

SEQ ID NO: 810485 - DNA, 20 bp, Artificial
  CRISPR gRNA sequence
cggatactggggaaagctca

SEQ ID NO: 810486 - DNA, 20 bp, Artificial
  CRISPR gRNA sequence
gggaaagctcactcagccca

SEQ ID NO: 810487 - DNA, 20 bp, Artificial
  CRISPR gRNA sequence
actcagcccacatgcatgtc

SEQ ID NO: 810488 - DNA, 20 bp, Artificial
  CRISPR gRNA sequence
agcccacatgcatgtctagc

SEQ ID NO: 810489 - DNA, 20 bp, Artificial
  CRISPR gRNA sequence
gcccagcagcagaatggagt

SEQ ID NO: 810490 - DNA, 20 bp, Artificial
  CRISPR gRNA sequence
atattcctgtcaaccaatgg

SEQ ID NO: 810491 - DNA, 20 bp, Artificial
  CRISPR gRNA sequence
ctgtcaaccaatgggcgtga

SEQ ID NO: 810492 - DNA, 20 bp, Artificial
  CRISPR gRNA sequence
tcaaccaatgggcgtgaagc

SEQ ID NO: 810493 - DNA, 20 bp, Artificial
  CRISPR gRNA sequence
ccacctgaaattctttgtct

SEQ ID NO: 810494 - DNA, 20 bp, Artificial
  CRISPR gRNA sequence
cacctgaaattctttgtctg

SEQ ID NO: 810495 - DNA, 20 bp, Artificial
  CRISPR gRNA sequence
aaattctttgtctgagtaga

SEQ ID NO: 810496 - DNA, 20 bp, Artificial
  CRISPR gRNA sequence
tttgtctgagtagacatctt

SEQ ID NO: 810497 - DNA, 20 bp, Artificial
  CRISPR gRNA sequence
tgtctgagtagacatcttag

SEQ ID NO: 810498 - DNA, 20 bp, Artificial
  CRISPR gRNA sequence
gtctgagtagacatcttagg

SEQ ID NO: 810499 - DNA, 20 bp, Artificial
  CRISPR gRNA sequence
tctgagtagacatcttagga

SEQ ID NO: 810500 - DNA, 20 bp, Artificial
  CRISPR gRNA sequence
agtagacatcttaggaggct

SEQ ID NO: 810501 - DNA, 20 bp, Artificial
  CRISPR gRNA sequence
aggaggctgtctacatgctg

SEQ ID NO: 810502 - DNA, 20 bp, Artificial
  CRISPR gRNA sequence
ggaggctgtctacatgctgg

SEQ ID NO: 810503 - DNA, 20 bp, Artificial
  CRISPR gRNA sequence
tctacatgctggtccttgaa

SEQ ID NO: 810504 - DNA, 20 bp, Artificial
  CRISPR gRNA sequence
catgctggtccttgaatatt

SEQ ID NO: 810505 - DNA, 20 bp, Artificial
  CRISPR gRNA sequence
gtccttgaatatttgagttt

SEQ ID NO: 810506 - DNA, 20 bp, Artificial
  CRISPR gRNA sequence
gaatatttgagtttctgttg

SEQ ID NO: 810507 - DNA, 20 bp, Artificial
  CRISPR gRNA sequence
aatatttgagtttctgttgt

SEQ ID NO: 810508 - DNA, 20 bp, Artificial
  CRISPR gRNA sequence
gagtttctgttgtccacact

SEQ ID NO: 810509 - DNA, 20 bp, Artificial
  CRISPR gRNA sequence
agtttctgttgtccacacta

SEQ ID NO: 810510 - DNA, 20 bp, Artificial
  CRISPR gRNA sequence
ctgttgtccacactacaact

SEQ ID NO: 810511 - DNA, 20 bp, Artificial
  CRISPR gRNA sequence
tgttgtccacactacaactt

SEQ ID NO: 810512 - DNA, 20 bp, Artificial
  CRISPR gRNA sequence
ttgtccacactacaactttg

SEQ ID NO: 810513 - DNA, 20 bp, Artificial
  CRISPR gRNA sequence
tccacactacaactttgata

SEQ ID NO: 810514 - DNA, 20 bp, Artificial
  CRISPR gRNA sequence
caactttgataatatactct

SEQ ID NO: 810515 - DNA, 20 bp, Artificial
  CRISPR gRNA sequence
tgataatatactcttatatt

SEQ ID NO: 810516 - DNA, 20 bp, Artificial
  CRISPR gRNA sequence
gataatatactcttatatta

SEQ ID NO: 810517 - DNA, 20 bp, Artificial
  CRISPR gRNA sequence
ataatatactcttatattac

SEQ ID NO: 810518 - DNA, 20 bp, Artificial
  CRISPR gRNA sequence
ttatattaccctctcttaaa

SEQ ID NO: 810519 - DNA, 20 bp, Artificial
  CRISPR gRNA sequence
atattaccctctcttaaact

SEQ ID NO: 810520 - DNA, 20 bp, Artificial
  CRISPR gRNA sequence
tattaccctctcttaaactc

SEQ ID NO: 810521 - DNA, 20 bp, Artificial
  CRISPR gRNA sequence
ccctctcttaaactcctaaa

SEQ ID NO: 810522 - DNA, 20 bp, Artificial
  CRISPR gRNA sequence
tcttaaactcctaaatctct

SEQ ID NO: 810523 - DNA, 20 bp, Artificial
  CRISPR gRNA sequence
ttaaactcctaaatctcttg

SEQ ID NO: 810524 - DNA, 20 bp, Artificial
  CRISPR gRNA sequence
aaactcctaaatctcttgct

SEQ ID NO: 810525 - DNA, 20 bp, Artificial
  CRISPR gRNA sequence
aactcctaaatctcttgctt

SEQ ID NO: 810526 - DNA, 20 bp, Artificial
  CRISPR gRNA sequence
ctaaatctcttgcttctgcc

SEQ ID NO: 810527 - DNA, 20 bp, Artificial
  CRISPR gRNA sequence
aatctcttgcttctgccctc

SEQ ID NO: 810528 - DNA, 20 bp, Artificial
  CRISPR gRNA sequence
ttgcttctgccctctggggt

SEQ ID NO: 810529 - DNA, 20 bp, Artificial
  CRISPR gRNA sequence
gcttctgccctctggggttg

SEQ ID NO: 810530 - DNA, 20 bp, Artificial
  CRISPR gRNA sequence
cttctgccctctggggttgc

SEQ ID NO: 810531 - DNA, 20 bp, Artificial
  CRISPR gRNA sequence
ctgccctctggggttgccaa

SEQ ID NO: 810532 - DNA, 20 bp, Artificial
  CRISPR gRNA sequence
tgccctctggggttgccaat

SEQ ID NO: 810533 - DNA, 20 bp, Artificial
  CRISPR gRNA sequence
ccctctggggttgccaatta

SEQ ID NO: 810534 - DNA, 20 bp, Artificial
  CRISPR gRNA sequence
tggggttgccaattaaatac

SEQ ID NO: 810535 - DNA, 20 bp, Artificial
  CRISPR gRNA sequence
gggttgccaattaaatacct

SEQ ID NO: 810536 - DNA, 20 bp, Artificial
  CRISPR gRNA sequence
ccaattaaatacctgcatgc

SEQ ID NO: 810537 - DNA, 20 bp, Artificial
  CRISPR gRNA sequence
aatacctgcatgccacacaa

SEQ ID NO: 810538 - DNA, 20 bp, Artificial
  CRISPR gRNA sequence
catgccacacaagtccttat

SEQ ID NO: 810539 - DNA, 20 bp, Artificial
  CRISPR gRNA sequence
atcataggctctgtcttacc

SEQ ID NO: 810540 - DNA, 20 bp, Artificial
  CRISPR gRNA sequence
tcataggctctgtcttacca

SEQ ID NO: 810541 - DNA, 20 bp, Artificial
  CRISPR gRNA sequence
tgtcttaccagctaagacaa

SEQ ID NO: 810542 - DNA, 20 bp, Artificial
  CRISPR gRNA sequence
tcttaccagctaagacaaag

SEQ ID NO: 810543 - DNA, 20 bp, Artificial
  CRISPR gRNA sequence
accagctaagacaaagggca

SEQ ID NO: 810544 - DNA, 20 bp, Artificial
  CRISPR gRNA sequence
ccagctaagacaaagggcaa

SEQ ID NO: 810545 - DNA, 20 bp, Artificial
  CRISPR gRNA sequence
agacaaagggcaaactgtga

SEQ ID NO: 810546 - DNA, 20 bp, Artificial
  CRISPR gRNA sequence
tgaaatacaatgacaatata

SEQ ID NO: 810547 - DNA, 20 bp, Artificial
  CRISPR gRNA sequence
tctataaagccagattgaat

SEQ ID NO: 810548 - DNA, 20 bp, Artificial
  CRISPR gRNA sequence
ctataaagccagattgaatc

SEQ ID NO: 810549 - DNA, 20 bp, Artificial
  CRISPR gRNA sequence
tataaagccagattgaatca

SEQ ID NO: 810550 - DNA, 20 bp, Artificial
  CRISPR gRNA sequence
taaagccagattgaatcagt

SEQ ID NO: 810551 - DNA, 20 bp, Artificial
  CRISPR gRNA sequence
aatcagtactagggactgtc

SEQ ID NO: 810552 - DNA, 20 bp, Artificial
  CRISPR gRNA sequence
gggactgtcctttagtctga

SEQ ID NO: 810553 - DNA, 20 bp, Artificial
  CRISPR gRNA sequence
tcctttagtctgagagtata

SEQ ID NO: 810554 - DNA, 20 bp, Artificial
  CRISPR gRNA sequence
tagtctgagagtatatccct

SEQ ID NO: 810555 - DNA, 20 bp, Artificial
  CRISPR gRNA sequence
agtctgagagtatatccctt

SEQ ID NO: 810556 - DNA, 20 bp, Artificial
  CRISPR gRNA sequence
gtctgagagtatatcccttc

SEQ ID NO: 810557 - DNA, 20 bp, Artificial
  CRISPR gRNA sequence
agagtatatcccttctcagt

SEQ ID NO: 810558 - DNA, 20 bp, Artificial
  CRISPR gRNA sequence
ctcagtaggataaataaaat

SEQ ID NO: 810559 - DNA, 20 bp, Artificial
  CRISPR gRNA sequence
tcagtaggataaataaaatt

SEQ ID NO: 810560 - DNA, 20 bp, Artificial
  CRISPR gRNA sequence
agtaggataaataaaattat

SEQ ID NO: 810561 - DNA, 20 bp, Artificial
  CRISPR gRNA sequence
tggctctccccaaagatgtc

SEQ ID NO: 810562 - DNA, 20 bp, Artificial
  CRISPR gRNA sequence
tccccaaagatgtccatatt

SEQ ID NO: 810563 - DNA, 20 bp, Artificial
  CRISPR gRNA sequence
cccaaagatgtccatattct

SEQ ID NO: 810564 - DNA, 20 bp, Artificial
  CRISPR gRNA sequence
taatccctggaacatgtgaa

SEQ ID NO: 810565 - DNA, 20 bp, Artificial
  CRISPR gRNA sequence
atccctggaacatgtgaata

SEQ ID NO: 810566 - DNA, 20 bp, Artificial
  CRISPR gRNA sequence
gaacatgtgaatatgtcacc

SEQ ID NO: 810567 - DNA, 20 bp, Artificial
  CRISPR gRNA sequence
acatggcaaaaggaattttg

SEQ ID NO: 810568 - DNA, 20 bp, Artificial
  CRISPR gRNA sequence
catggcaaaaggaattttga

SEQ ID NO: 810569 - DNA, 20 bp, Artificial
  CRISPR gRNA sequence
tgaagatggaccttgagatg

SEQ ID NO: 810570 - DNA, 20 bp, Artificial
  CRISPR gRNA sequence
gaagatggaccttgagatgg

SEQ ID NO: 810571 - DNA, 20 bp, Artificial
  CRISPR gRNA sequence
aagatggaccttgagatggg

SEQ ID NO: 810572 - DNA, 20 bp, Artificial
  CRISPR gRNA sequence
gagatgggaagatcacccca

SEQ ID NO: 810573 - DNA, 20 bp, Artificial
  CRISPR gRNA sequence
agatgggaagatcaccccaa

SEQ ID NO: 810574 - DNA, 20 bp, Artificial
  CRISPR gRNA sequence
atgcaatcacaagggtcctt

SEQ ID NO: 810575 - DNA, 20 bp, Artificial
  CRISPR gRNA sequence
aagaggtggcaaagagaagc

SEQ ID NO: 810576 - DNA, 20 bp, Artificial
  CRISPR gRNA sequence
agaggtggcaaagagaagca

SEQ ID NO: 810577 - DNA, 20 bp, Artificial
  CRISPR gRNA sequence
gttagggaaagagatgtggc

SEQ ID NO: 810578 - DNA, 20 bp, Artificial
  CRISPR gRNA sequence
gggaaagagatgtggctgat

SEQ ID NO: 810579 - DNA, 20 bp, Artificial
  CRISPR gRNA sequence
atcatgatggctcacgcctg

SEQ ID NO: 810580 - DNA, 20 bp, Artificial
  CRISPR gRNA sequence
acgcctgtaatcctagcaat

SEQ ID NO: 810581 - DNA, 20 bp, Artificial
  CRISPR gRNA sequence
taatcctagcaatttgggag

SEQ ID NO: 810582 - DNA, 20 bp, Artificial
  CRISPR gRNA sequence
gcaatttgggaggctgaggc

SEQ ID NO: 810583 - DNA, 20 bp, Artificial
  CRISPR gRNA sequence
gggaggctgaggcgggcgga

SEQ ID NO: 810584 - DNA, 20 bp, Artificial
  CRISPR gRNA sequence
ggaggctgaggcgggcggat

SEQ ID NO: 810585 - DNA, 20 bp, Artificial
  CRISPR gRNA sequence
aggcgggcggatcacctgag

SEQ ID NO: 810586 - DNA, 20 bp, Artificial
  CRISPR gRNA sequence
aggtcaggagtttgagacca

SEQ ID NO: 810587 - DNA, 20 bp, Artificial
  CRISPR gRNA sequence
gagaccagcctggccaacat

SEQ ID NO: 810588 - DNA, 20 bp, Artificial
  CRISPR gRNA sequence
agaccagcctggccaacatg

SEQ ID NO: 810589 - DNA, 20 bp, Artificial
  CRISPR gRNA sequence
gccaacatggtgaaacccat

SEQ ID NO: 810590 - DNA, 20 bp, Artificial
  CRISPR gRNA sequence
tactaaaaatacaaaaatta

SEQ ID NO: 810591 - DNA, 20 bp, Artificial
  CRISPR gRNA sequence
ctaaaaatacaaaaattagc

SEQ ID NO: 810592 - DNA, 20 bp, Artificial
  CRISPR gRNA sequence
aaaatacaaaaattagccag

SEQ ID NO: 810593 - DNA, 20 bp, Artificial
  CRISPR gRNA sequence
gccaggcatgttggcatgtg

SEQ ID NO: 810594 - DNA, 20 bp, Artificial
  CRISPR gRNA sequence
gcatgtgcctgtaatcccag

SEQ ID NO: 810595 - DNA, 20 bp, Artificial
  CRISPR gRNA sequence
taatcccagctactcaggag

SEQ ID NO: 810596 - DNA, 20 bp, Artificial
  CRISPR gRNA sequence
ctcaggaggctgagacagga

SEQ ID NO: 810597 - DNA, 20 bp, Artificial
  CRISPR gRNA sequence
aggaggctgagacaggagaa

SEQ ID NO: 810598 - DNA, 20 bp, Artificial
  CRISPR gRNA sequence
agacaggagaatagcttgaa

SEQ ID NO: 810599 - DNA, 20 bp, Artificial
  CRISPR gRNA sequence
gaacccgggaggcaggggtt

SEQ ID NO: 810600 - DNA, 20 bp, Artificial
  CRISPR gRNA sequence
aacccgggaggcaggggttg

SEQ ID NO: 810601 - DNA, 20 bp, Artificial
  CRISPR gRNA sequence
cagtgagccgggatcgtgcc

SEQ ID NO: 810602 - DNA, 20 bp, Artificial
  CRISPR gRNA sequence
cattccagcctggggggcag

SEQ ID NO: 810603 - DNA, 20 bp, Artificial
  CRISPR gRNA sequence
cagcctggggggcagaataa

SEQ ID NO: 810604 - DNA, 20 bp, Artificial
  CRISPR gRNA sequence
gggggcagaataagacttca

SEQ ID NO: 810605 - DNA, 20 bp, Artificial
  CRISPR gRNA sequence
catctcaaaaaaaaaaaaga

SEQ ID NO: 810606 - DNA, 20 bp, Artificial
  CRISPR gRNA sequence
atctcaaaaaaaaaaaagag

SEQ ID NO: 810607 - DNA, 20 bp, Artificial
  CRISPR gRNA sequence
aaaaaaaaaaaagagagaga

SEQ ID NO: 810608 - DNA, 20 bp, Artificial
  CRISPR gRNA sequence
aatgatagggttgctgcctc

SEQ ID NO: 810609 - DNA, 20 bp, Artificial
  CRISPR gRNA sequence
ctgcctctgaagatagaggg

SEQ ID NO: 810610 - DNA, 20 bp, Artificial
  CRISPR gRNA sequence
cctctgaagatagagggagg

SEQ ID NO: 810611 - DNA, 20 bp, Artificial
  CRISPR gRNA sequence
tgaagatagagggaggggcc

SEQ ID NO: 810612 - DNA, 20 bp, Artificial
  CRISPR gRNA sequence
aagatagagggaggggccat

SEQ ID NO: 810613 - DNA, 20 bp, Artificial
  CRISPR gRNA sequence
atgcaggtggcctctagcag

SEQ ID NO: 810614 - DNA, 20 bp, Artificial
  CRISPR gRNA sequence
tagcagctggaaaagacagg

SEQ ID NO: 810615 - DNA, 20 bp, Artificial
  CRISPR gRNA sequence
gcagctggaaaagacaggaa

SEQ ID NO: 810616 - DNA, 20 bp, Artificial
  CRISPR gRNA sequence
gaaaagacaggaaagtggaa

SEQ ID NO: 810617 - DNA, 20 bp, Artificial
  CRISPR gRNA sequence
cccttagggcctctgcaatc

SEQ ID NO: 810618 - DNA, 20 bp, Artificial
  CRISPR gRNA sequence
ccttagggcctctgcaatcc

SEQ ID NO: 810619 - DNA, 20 bp, Artificial
  CRISPR gRNA sequence
agggcctctgcaatcctgct

SEQ ID NO: 810620 - DNA, 20 bp, Artificial
  CRISPR gRNA sequence
gggcctctgcaatcctgctg

SEQ ID NO: 810621 - DNA, 20 bp, Artificial
  CRISPR gRNA sequence
tgcaatcctgctgacacctt

SEQ ID NO: 810622 - DNA, 20 bp, Artificial
  CRISPR gRNA sequence
caatcctgctgacaccttga

SEQ ID NO: 810623 - DNA, 20 bp, Artificial
  CRISPR gRNA sequence
ctgacaccttgatttgagcc

SEQ ID NO: 810624 - DNA, 20 bp, Artificial
  CRISPR gRNA sequence
acaccttgatttgagcccag

SEQ ID NO: 810625 - DNA, 20 bp, Artificial
  CRISPR gRNA sequence
gatttgagcccagtgaaact

SEQ ID NO: 810626 - DNA, 20 bp, Artificial
  CRISPR gRNA sequence
atttgagcccagtgaaactc

SEQ ID NO: 810627 - DNA, 20 bp, Artificial
  CRISPR gRNA sequence
gagcccagtgaaactcaagt

SEQ ID NO: 810628 - DNA, 20 bp, Artificial
  CRISPR gRNA sequence
agcccagtgaaactcaagtc

SEQ ID NO: 810629 - DNA, 20 bp, Artificial
  CRISPR gRNA sequence
aagtctggctttctgacctc

SEQ ID NO: 810630 - DNA, 20 bp, Artificial
  CRISPR gRNA sequence
gctttctgacctccataagt

SEQ ID NO: 810631 - DNA, 20 bp, Artificial
  CRISPR gRNA sequence
tctgacctccataagtatca

SEQ ID NO: 810632 - DNA, 20 bp, Artificial
  CRISPR gRNA sequence
ctgacctccataagtatcag

SEQ ID NO: 810633 - DNA, 20 bp, Artificial
  CRISPR gRNA sequence
tgacctccataagtatcaga

SEQ ID NO: 810634 - DNA, 20 bp, Artificial
  CRISPR gRNA sequence
acctccataagtatcagata

SEQ ID NO: 810635 - DNA, 20 bp, Artificial
  CRISPR gRNA sequence
cataagtatcagataataaa

SEQ ID NO: 810636 - DNA, 20 bp, Artificial
  CRISPR gRNA sequence
tgttgtcttaaactgtgaag

SEQ ID NO: 810637 - DNA, 20 bp, Artificial
  CRISPR gRNA sequence
tcttaaactgtgaagcttgt

SEQ ID NO: 810638 - DNA, 20 bp, Artificial
  CRISPR gRNA sequence
aaactgtgaagcttgtggta

SEQ ID NO: 810639 - DNA, 20 bp, Artificial
  CRISPR gRNA sequence
aactgtgaagcttgtggtaa

SEQ ID NO: 810640 - DNA, 20 bp, Artificial
  CRISPR gRNA sequence
tgaagcttgtggtaatttga

SEQ ID NO: 810641 - DNA, 20 bp, Artificial
  CRISPR gRNA sequence
gtggtaatttgatataagag

SEQ ID NO: 810642 - DNA, 20 bp, Artificial
  CRISPR gRNA sequence
tggtaatttgatataagagc

SEQ ID NO: 810643 - DNA, 20 bp, Artificial
  CRISPR gRNA sequence
gatataagagcattagaaaa

SEQ ID NO: 810644 - DNA, 20 bp, Artificial
  CRISPR gRNA sequence
atataagagcattagaaaac

SEQ ID NO: 810645 - DNA, 20 bp, Artificial
  CRISPR gRNA sequence
gaaaacatatgcactcggtg

SEQ ID NO: 810646 - DNA, 20 bp, Artificial
  CRISPR gRNA sequence
ggtgatgaaattacctgtct

SEQ ID NO: 810647 - DNA, 20 bp, Artificial
  CRISPR gRNA sequence
cctgtctcttacgaaatgat

SEQ ID NO: 810648 - DNA, 20 bp, Artificial
  CRISPR gRNA sequence
tctcttacgaaatgattatg

SEQ ID NO: 810649 - DNA, 20 bp, Artificial
  CRISPR gRNA sequence
ttacgaaatgattatgatac

SEQ ID NO: 810650 - DNA, 20 bp, Artificial
  CRISPR gRNA sequence
acgaaatgattatgatacta

SEQ ID NO: 810651 - DNA, 20 bp, Artificial
  CRISPR gRNA sequence
cgaaatgattatgatactag

SEQ ID NO: 810652 - DNA, 20 bp, Artificial
  CRISPR gRNA sequence
tgatactaggtgttagttgt

SEQ ID NO: 810653 - DNA, 20 bp, Artificial
  CRISPR gRNA sequence
ggtgttagttgtccttactg

SEQ ID NO: 810654 - DNA, 20 bp, Artificial
  CRISPR gRNA sequence
gttgtccttactgggcagat

SEQ ID NO: 810655 - DNA, 20 bp, Artificial
  CRISPR gRNA sequence
tccttactgggcagataaaa

SEQ ID NO: 810656 - DNA, 20 bp, Artificial
  CRISPR gRNA sequence
actgggcagataaaagttgt

SEQ ID NO: 810657 - DNA, 20 bp, Artificial
  CRISPR gRNA sequence
ctgggcagataaaagttgtt

SEQ ID NO: 810658 - DNA, 20 bp, Artificial
  CRISPR gRNA sequence
ggcagataaaagttgttatt

SEQ ID NO: 810659 - DNA, 20 bp, Artificial
  CRISPR gRNA sequence
ttattttcccaagattgttt

SEQ ID NO: 810660 - DNA, 20 bp, Artificial
  CRISPR gRNA sequence
ttttcccaagattgtttgaa

SEQ ID NO: 810661 - DNA, 20 bp, Artificial
  CRISPR gRNA sequence
tcccaagattgtttgaaatt

SEQ ID NO: 810662 - DNA, 20 bp, Artificial
  CRISPR gRNA sequence
cccaagattgtttgaaattc

SEQ ID NO: 810663 - DNA, 20 bp, Artificial
  CRISPR gRNA sequence
ccaagattgtttgaaattct

SEQ ID NO: 810664 - DNA, 20 bp, Artificial
  CRISPR gRNA sequence
tttgaaattctgctgtatga

SEQ ID NO: 810665 - DNA, 20 bp, Artificial
  CRISPR gRNA sequence
gaaattctgctgtatgaagt

SEQ ID NO: 810666 - DNA, 20 bp, Artificial
  CRISPR gRNA sequence
aaattctgctgtatgaagtt

SEQ ID NO: 810667 - DNA, 20 bp, Artificial
  CRISPR gRNA sequence
tgctgtatgaagttcaaaag

SEQ ID NO: 810668 - DNA, 20 bp, Artificial
  CRISPR gRNA sequence
ctgtatgaagttcaaaagta

SEQ ID NO: 810669 - DNA, 20 bp, Artificial
  CRISPR gRNA sequence
tatgaagttcaaaagtatgg

SEQ ID NO: 810670 - DNA, 20 bp, Artificial
  CRISPR gRNA sequence
aaaagtatgggatcccttcc

SEQ ID NO: 810671 - DNA, 20 bp, Artificial
  CRISPR gRNA sequence
ccaaaaatatccagcatagt

SEQ ID NO: 810672 - DNA, 20 bp, Artificial
  CRISPR gRNA sequence
caaaaatatccagcatagtc

SEQ ID NO: 810673 - DNA, 20 bp, Artificial
  CRISPR gRNA sequence
tgaagaattttgttagagac

SEQ ID NO: 810674 - DNA, 20 bp, Artificial
  CRISPR gRNA sequence
aagaattttgttagagacca

SEQ ID NO: 810675 - DNA, 20 bp, Artificial
  CRISPR gRNA sequence
tgttagagaccaaatttctt

SEQ ID NO: 810676 - DNA, 20 bp, Artificial
  CRISPR gRNA sequence
gttagagaccaaatttcttg

SEQ ID NO: 810677 - DNA, 20 bp, Artificial
  CRISPR gRNA sequence
ttagagaccaaatttcttgg

SEQ ID NO: 810678 - DNA, 20 bp, Artificial
  CRISPR gRNA sequence
gagaccaaatttcttggaaa

SEQ ID NO: 810679 - DNA, 20 bp, Artificial
  CRISPR gRNA sequence
cttggaaaaacccataacca

SEQ ID NO: 810680 - DNA, 20 bp, Artificial
  CRISPR gRNA sequence
ttggaaaaacccataaccag

SEQ ID NO: 810681 - DNA, 20 bp, Artificial
  CRISPR gRNA sequence
ggaaaaacccataaccagct

SEQ ID NO: 810682 - DNA, 20 bp, Artificial
  CRISPR gRNA sequence
gaaaaacccataaccagctg

SEQ ID NO: 810683 - DNA, 20 bp, Artificial
  CRISPR gRNA sequence
actggcagcaagtacagcaa

SEQ ID NO: 810684 - DNA, 20 bp, Artificial
  CRISPR gRNA sequence
gcagcaagtacagcaaagga

SEQ ID NO: 810685 - DNA, 20 bp, Artificial
  CRISPR gRNA sequence
atcctgctggctcatgacac

SEQ ID NO: 810686 - DNA, 20 bp, Artificial
  CRISPR gRNA sequence
ctggctcatgacactgtgca

SEQ ID NO: 810687 - DNA, 20 bp, Artificial
  CRISPR gRNA sequence
gctcatgacactgtgcatga

SEQ ID NO: 810688 - DNA, 20 bp, Artificial
  CRISPR gRNA sequence
atgacactgtgcatgaatca

SEQ ID NO: 810689 - DNA, 20 bp, Artificial
  CRISPR gRNA sequence
tgcatgaatcacagtgatta

SEQ ID NO: 810690 - DNA, 20 bp, Artificial
  CRISPR gRNA sequence
gctattgtactagatatttt

SEQ ID NO: 810691 - DNA, 20 bp, Artificial
  CRISPR gRNA sequence
ttgtactagatattttctgt

SEQ ID NO: 810692 - DNA, 20 bp, Artificial
  CRISPR gRNA sequence
tactagatattttctgtttc

SEQ ID NO: 810693 - DNA, 20 bp, Artificial
  CRISPR gRNA sequence
gatattttctgtttcctctc

SEQ ID NO: 810694 - DNA, 20 bp, Artificial
  CRISPR gRNA sequence
tctgtttcctctccagatct

SEQ ID NO: 810695 - DNA, 20 bp, Artificial
  CRISPR gRNA sequence
ctgtttcctctccagatcta

SEQ ID NO: 810696 - DNA, 20 bp, Artificial
  CRISPR gRNA sequence
tgtttcctctccagatctat

SEQ ID NO: 810697 - DNA, 20 bp, Artificial
  CRISPR gRNA sequence
tttcctctccagatctattc

SEQ ID NO: 810698 - DNA, 20 bp, Artificial
  CRISPR gRNA sequence
cctctccagatctattctgt

SEQ ID NO: 810699 - DNA, 20 bp, Artificial
  CRISPR gRNA sequence
ctctccagatctattctgta

SEQ ID NO: 810700 - DNA, 20 bp, Artificial
  CRISPR gRNA sequence
tccagatctattctgtacat

SEQ ID NO: 810701 - DNA, 20 bp, Artificial
  CRISPR gRNA sequence
cagatctattctgtacatgt

SEQ ID NO: 810702 - DNA, 20 bp, Artificial
  CRISPR gRNA sequence
ttctgtacatgtcaatattg

SEQ ID NO: 810703 - DNA, 20 bp, Artificial
  CRISPR gRNA sequence
tgtacatgtcaatattgctc

SEQ ID NO: 810704 - DNA, 20 bp, Artificial
  CRISPR gRNA sequence
tacatgtcaatattgctctg

SEQ ID NO: 810705 - DNA, 20 bp, Artificial
  CRISPR gRNA sequence
ctctgagccctgagaagttg

SEQ ID NO: 810706 - DNA, 20 bp, Artificial
  CRISPR gRNA sequence
tgagccctgagaagttgact

SEQ ID NO: 810707 - DNA, 20 bp, Artificial
  CRISPR gRNA sequence
agccctgagaagttgacttt

SEQ ID NO: 810708 - DNA, 20 bp, Artificial
  CRISPR gRNA sequence
agaagttgacttttatggaa

SEQ ID NO: 810709 - DNA, 20 bp, Artificial
  CRISPR gRNA sequence
acttttatggaatacaacag

SEQ ID NO: 810710 - DNA, 20 bp, Artificial
  CRISPR gRNA sequence
ttatggaatacaacagtgga

SEQ ID NO: 810711 - DNA, 20 bp, Artificial
  CRISPR gRNA sequence
tatggaatacaacagtggac

SEQ ID NO: 810712 - DNA, 20 bp, Artificial
  CRISPR gRNA sequence
atggaatacaacagtggacc

SEQ ID NO: 810713 - DNA, 20 bp, Artificial
  CRISPR gRNA sequence
tggaatacaacagtggaccc

SEQ ID NO: 810714 - DNA, 20 bp, Artificial
  CRISPR gRNA sequence
gtattctctgacttctagct

SEQ ID NO: 810715 - DNA, 20 bp, Artificial
  CRISPR gRNA sequence
tattctctgacttctagctg

SEQ ID NO: 810716 - DNA, 20 bp, Artificial
  CRISPR gRNA sequence
tctgacttctagctgggttc

SEQ ID NO: 810717 - DNA, 20 bp, Artificial
  CRISPR gRNA sequence
tgacttctagctgggttcag

SEQ ID NO: 810718 - DNA, 20 bp, Artificial
  CRISPR gRNA sequence
acttctagctgggttcagcc

SEQ ID NO: 810719 - DNA, 20 bp, Artificial
  CRISPR gRNA sequence
ctagctgggttcagccaatg

SEQ ID NO: 810720 - DNA, 20 bp, Artificial
  CRISPR gRNA sequence
tagctgggttcagccaatgg

SEQ ID NO: 810721 - DNA, 20 bp, Artificial
  CRISPR gRNA sequence
gctgggttcagccaatggga

SEQ ID NO: 810722 - DNA, 20 bp, Artificial
  CRISPR gRNA sequence
ggttcagccaatgggaggtg

SEQ ID NO: 810723 - DNA, 20 bp, Artificial
  CRISPR gRNA sequence
agccaatgggaggtgctagc

SEQ ID NO: 810724 - DNA, 20 bp, Artificial
  CRISPR gRNA sequence
gcaggagattggagggtggg

SEQ ID NO: 810725 - DNA, 20 bp, Artificial
  CRISPR gRNA sequence
gagggtgggaggagaatgag

SEQ ID NO: 810726 - DNA, 20 bp, Artificial
  CRISPR gRNA sequence
gggtattcattcatccagtt

SEQ ID NO: 810727 - DNA, 20 bp, Artificial
  CRISPR gRNA sequence
attcatccagtttccaccct

SEQ ID NO: 810728 - DNA, 20 bp, Artificial
  CRISPR gRNA sequence
atccagtttccaccctttgg

SEQ ID NO: 810729 - DNA, 20 bp, Artificial
  CRISPR gRNA sequence
ccaccctttggagtcgctgc

SEQ ID NO: 810730 - DNA, 20 bp, Artificial
  CRISPR gRNA sequence
caccctttggagtcgctgca

SEQ ID NO: 810731 - DNA, 20 bp, Artificial
  CRISPR gRNA sequence
tggagtcgctgcatgtggca

SEQ ID NO: 810732 - DNA, 20 bp, Artificial
  CRISPR gRNA sequence
ggagtcgctgcatgtggcag

SEQ ID NO: 810733 - DNA, 20 bp, Artificial
  CRISPR gRNA sequence
gagtcgctgcatgtggcagc

SEQ ID NO: 810734 - DNA, 20 bp, Artificial
  CRISPR gRNA sequence
catgtggcagcttccctatt

SEQ ID NO: 810735 - DNA, 20 bp, Artificial
  CRISPR gRNA sequence
ccctattctgtggctacagc

SEQ ID NO: 810736 - DNA, 20 bp, Artificial
  CRISPR gRNA sequence
cctattctgtggctacagct

SEQ ID NO: 810737 - DNA, 20 bp, Artificial
  CRISPR gRNA sequence
ttctgtggctacagctcctg

SEQ ID NO: 810738 - DNA, 20 bp, Artificial
  CRISPR gRNA sequence
tgtggctacagctcctggga

SEQ ID NO: 810739 - DNA, 20 bp, Artificial
  CRISPR gRNA sequence
tggctacagctcctgggaag

SEQ ID NO: 810740 - DNA, 20 bp, Artificial
  CRISPR gRNA sequence
cagctcctgggaagtggggc

SEQ ID NO: 810741 - DNA, 20 bp, Artificial
  CRISPR gRNA sequence
ctgggaagtggggctttccc

SEQ ID NO: 810742 - DNA, 20 bp, Artificial
  CRISPR gRNA sequence
ggaagtggggctttccctac

SEQ ID NO: 810743 - DNA, 20 bp, Artificial
  CRISPR gRNA sequence
tccctacagctcccttctga

SEQ ID NO: 810744 - DNA, 20 bp, Artificial
  CRISPR gRNA sequence
ccctacagctcccttctgat

SEQ ID NO: 810745 - DNA, 20 bp, Artificial
  CRISPR gRNA sequence
cctacagctcccttctgatt

SEQ ID NO: 810746 - DNA, 20 bp, Artificial
  CRISPR gRNA sequence
cagctcccttctgattccag

SEQ ID NO: 810747 - DNA, 20 bp, Artificial
  CRISPR gRNA sequence
ccttctgattccagtaactt

SEQ ID NO: 810748 - DNA, 20 bp, Artificial
  CRISPR gRNA sequence
ctgattccagtaacttctcc

SEQ ID NO: 810749 - DNA, 20 bp, Artificial
  CRISPR gRNA sequence
tgattccagtaacttctcca

SEQ ID NO: 810750 - DNA, 20 bp, Artificial
  CRISPR gRNA sequence
attccagtaacttctccaac

SEQ ID NO: 810751 - DNA, 20 bp, Artificial
  CRISPR gRNA sequence
cagtaacttctccaacagtg

SEQ ID NO: 810752 - DNA, 20 bp, Artificial
  CRISPR gRNA sequence
ctccaacagtggtaattgcc

SEQ ID NO: 810753 - DNA, 20 bp, Artificial
  CRISPR gRNA sequence
tccaacagtggtaattgccc

SEQ ID NO: 810754 - DNA, 20 bp, Artificial
  CRISPR gRNA sequence
caacagtggtaattgccctc

SEQ ID NO: 810755 - DNA, 20 bp, Artificial
  CRISPR gRNA sequence
ccctcccaacattgaagccc

SEQ ID NO: 810756 - DNA, 20 bp, Artificial
  CRISPR gRNA sequence
ccaacattgaagccccagtg

SEQ ID NO: 810757 - DNA, 20 bp, Artificial
  CRISPR gRNA sequence
aagccccagtgttctgcact

SEQ ID NO: 810758 - DNA, 20 bp, Artificial
  CRISPR gRNA sequence
tgcactatcctttgtagttt

SEQ ID NO: 810759 - DNA, 20 bp, Artificial
  CRISPR gRNA sequence
cactatcctttgtagtttct

SEQ ID NO: 810760 - DNA, 20 bp, Artificial
  CRISPR gRNA sequence
tcctttgtagtttctccaaa

SEQ ID NO: 810761 - DNA, 20 bp, Artificial
  CRISPR gRNA sequence
tgtagtttctccaaatggtg

SEQ ID NO: 810762 - DNA, 20 bp, Artificial
  CRISPR gRNA sequence
gtagtttctccaaatggtga

SEQ ID NO: 810763 - DNA, 20 bp, Artificial
  CRISPR gRNA sequence
tagtttctccaaatggtgat

SEQ ID NO: 810764 - DNA, 20 bp, Artificial
  CRISPR gRNA sequence
ctccaaatggtgatcacacc

SEQ ID NO: 810765 - DNA, 20 bp, Artificial
  CRISPR gRNA sequence
tccaaatggtgatcacacct

SEQ ID NO: 810766 - DNA, 20 bp, Artificial
  CRISPR gRNA sequence
caaatggtgatcacaccttt

SEQ ID NO: 810767 - DNA, 20 bp, Artificial
  CRISPR gRNA sequence
tgtaaacagtccctttatta

SEQ ID NO: 810768 - DNA, 20 bp, Artificial
  CRISPR gRNA sequence
gtaaacagtccctttattac

SEQ ID NO: 810769 - DNA, 20 bp, Artificial
  CRISPR gRNA sequence
taaacagtccctttattaca

SEQ ID NO: 810770 - DNA, 20 bp, Artificial
  CRISPR gRNA sequence
tattacactctcctcaaatc

SEQ ID NO: 810771 - DNA, 20 bp, Artificial
  CRISPR gRNA sequence
attacactctcctcaaatca

SEQ ID NO: 810772 - DNA, 20 bp, Artificial
  CRISPR gRNA sequence
ttacactctcctcaaatcac

SEQ ID NO: 810773 - DNA, 20 bp, Artificial
  CRISPR gRNA sequence
cactctcctcaaatcactcg

SEQ ID NO: 810774 - DNA, 20 bp, Artificial
  CRISPR gRNA sequence
tcctcaaatcactcgagtat

SEQ ID NO: 810775 - DNA, 20 bp, Artificial
  CRISPR gRNA sequence
ctcaaatcactcgagtatgc

SEQ ID NO: 810776 - DNA, 20 bp, Artificial
  CRISPR gRNA sequence
aaatcactcgagtatgccat

SEQ ID NO: 810777 - DNA, 20 bp, Artificial
  CRISPR gRNA sequence
gagtatgccatctgtttctt

SEQ ID NO: 810778 - DNA, 20 bp, Artificial
  CRISPR gRNA sequence
tttcttgtctgaaccctaac

SEQ ID NO: 810779 - DNA, 20 bp, Artificial
  CRISPR gRNA sequence
cttgtctgaaccctaactga

SEQ ID NO: 810780 - DNA, 20 bp, Artificial
  CRISPR gRNA sequence
ttgtctgaaccctaactgat

SEQ ID NO: 810781 - DNA, 20 bp, Artificial
  CRISPR gRNA sequence
gtctgaaccctaactgatag

SEQ ID NO: 810782 - DNA, 20 bp, Artificial
  CRISPR gRNA sequence
tctgaaccctaactgataga

SEQ ID NO: 810783 - DNA, 20 bp, Artificial
  CRISPR gRNA sequence
aaccctaactgatagaccta

SEQ ID NO: 810784 - DNA, 20 bp, Artificial
  CRISPR gRNA sequence
actgatagacctaggaagtg

SEQ ID NO: 810785 - DNA, 20 bp, Artificial
  CRISPR gRNA sequence
atagacctaggaagtggggg

SEQ ID NO: 810786 - DNA, 20 bp, Artificial
  CRISPR gRNA sequence
ggaagtgggggcagctctta

SEQ ID NO: 810787 - DNA, 20 bp, Artificial
  CRISPR gRNA sequence
ttactttgaaggtcaatgct

SEQ ID NO: 810788 - DNA, 20 bp, Artificial
  CRISPR gRNA sequence
actttgaaggtcaatgctgg

SEQ ID NO: 810789 - DNA, 20 bp, Artificial
  CRISPR gRNA sequence
ctttgaaggtcaatgctggc

SEQ ID NO: 810790 - DNA, 20 bp, Artificial
  CRISPR gRNA sequence
tgaaggtcaatgctggccaa

SEQ ID NO: 810791 - DNA, 20 bp, Artificial
  CRISPR gRNA sequence
gaaggtcaatgctggccaaa

SEQ ID NO: 810792 - DNA, 20 bp, Artificial
  CRISPR gRNA sequence
aaggtcaatgctggccaaag

SEQ ID NO: 810793 - DNA, 20 bp, Artificial
  CRISPR gRNA sequence
gccaaagtaagttccctcac

SEQ ID NO: 810794 - DNA, 20 bp, Artificial
  CRISPR gRNA sequence
cctcacgtgagtattccaga

SEQ ID NO: 810795 - DNA, 20 bp, Artificial
  CRISPR gRNA sequence
acgtgagtattccagaacac

SEQ ID NO: 810796 - DNA, 20 bp, Artificial
  CRISPR gRNA sequence
cagaacacacagctgaagtt

SEQ ID NO: 810797 - DNA, 20 bp, Artificial
  CRISPR gRNA sequence
aagtttctgccagggggtgg

SEQ ID NO: 810798 - DNA, 20 bp, Artificial
  CRISPR gRNA sequence
ctgccagggggtggctttag

SEQ ID NO: 810799 - DNA, 20 bp, Artificial
  CRISPR gRNA sequence
tgccagggggtggctttagg

SEQ ID NO: 810800 - DNA, 20 bp, Artificial
  CRISPR gRNA sequence
ccagggggtggctttaggcg

SEQ ID NO: 810801 - DNA, 20 bp, Artificial
  CRISPR gRNA sequence
taggcgcagaacactggtga

SEQ ID NO: 810802 - DNA, 20 bp, Artificial
  CRISPR gRNA sequence
aggcgcagaacactggtgac

SEQ ID NO: 810803 - DNA, 20 bp, Artificial
  CRISPR gRNA sequence
ggcgcagaacactggtgacc

SEQ ID NO: 810804 - DNA, 20 bp, Artificial
  CRISPR gRNA sequence
gtgacctggtagaggccttc

SEQ ID NO: 810805 - DNA, 20 bp, Artificial
  CRISPR gRNA sequence
gtagaggccttcaggggtcc

SEQ ID NO: 810806 - DNA, 20 bp, Artificial
  CRISPR gRNA sequence
caggggtcctggagtggctg

SEQ ID NO: 810807 - DNA, 20 bp, Artificial
  CRISPR gRNA sequence
aggggtcctggagtggctgg

SEQ ID NO: 810808 - DNA, 20 bp, Artificial
  CRISPR gRNA sequence
gagtggctggtgttggcagg

SEQ ID NO: 810809 - DNA, 20 bp, Artificial
  CRISPR gRNA sequence
gtgttggcaggaacgctgac

SEQ ID NO: 810810 - DNA, 20 bp, Artificial
  CRISPR gRNA sequence
gcaggaacgctgacgtttgg

SEQ ID NO: 810811 - DNA, 20 bp, Artificial
  CRISPR gRNA sequence
acgtttggccaggatacttc

SEQ ID NO: 810812 - DNA, 20 bp, Artificial
  CRISPR gRNA sequence
ggccaggatacttctgccag

SEQ ID NO: 810813 - DNA, 20 bp, Artificial
  CRISPR gRNA sequence
gccaggatacttctgccaga

SEQ ID NO: 810814 - DNA, 20 bp, Artificial
  CRISPR gRNA sequence
ctgccagaggataacctgta

SEQ ID NO: 810815 - DNA, 20 bp, Artificial
  CRISPR gRNA sequence
tgccagaggataacctgtag

SEQ ID NO: 810816 - DNA, 20 bp, Artificial
  CRISPR gRNA sequence
ccagaggataacctgtagcc

SEQ ID NO: 810817 - DNA, 20 bp, Artificial
  CRISPR gRNA sequence
tagcctggcaggtgagctct

SEQ ID NO: 810818 - DNA, 20 bp, Artificial
  CRISPR gRNA sequence
gcaggtgagctctacctcat

SEQ ID NO: 810819 - DNA, 20 bp, Artificial
  CRISPR gRNA sequence
tacctcatctgtttctggaa

SEQ ID NO: 810820 - DNA, 20 bp, Artificial
  CRISPR gRNA sequence
cctcatctgtttctggaacc

SEQ ID NO: 810821 - DNA, 20 bp, Artificial
  CRISPR gRNA sequence
atctgtttctggaaccttta

SEQ ID NO: 810822 - DNA, 20 bp, Artificial
  CRISPR gRNA sequence
tttctggaacctttaggatg

SEQ ID NO: 810823 - DNA, 20 bp, Artificial
  CRISPR gRNA sequence
ctggaacctttaggatgtga

SEQ ID NO: 810824 - DNA, 20 bp, Artificial
  CRISPR gRNA sequence
tggaacctttaggatgtgag

SEQ ID NO: 810825 - DNA, 20 bp, Artificial
  CRISPR gRNA sequence
gaacctttaggatgtgagtg

SEQ ID NO: 810826 - DNA, 20 bp, Artificial
  CRISPR gRNA sequence
taggatgtgagtgtttattt

SEQ ID NO: 810827 - DNA, 20 bp, Artificial
  CRISPR gRNA sequence
aggatgtgagtgtttatttt

SEQ ID NO: 810828 - DNA, 20 bp, Artificial
  CRISPR gRNA sequence
ggatgtgagtgtttattttc

SEQ ID NO: 810829 - DNA, 20 bp, Artificial
  CRISPR gRNA sequence
attttcctgtaggaagctgg

SEQ ID NO: 810830 - DNA, 20 bp, Artificial
  CRISPR gRNA sequence
ttttcctgtaggaagctgga

SEQ ID NO: 810831 - DNA, 20 bp, Artificial
  CRISPR gRNA sequence
tcctgtaggaagctggacaa

SEQ ID NO: 810832 - DNA, 20 bp, Artificial
  CRISPR gRNA sequence
cctgtaggaagctggacaat

SEQ ID NO: 810833 - DNA, 20 bp, Artificial
  CRISPR gRNA sequence
ctgtaggaagctggacaata

SEQ ID NO: 810834 - DNA, 20 bp, Artificial
  CRISPR gRNA sequence
taggaagctggacaatagag

SEQ ID NO: 810835 - DNA, 20 bp, Artificial
  CRISPR gRNA sequence
gacaatagagaagaaaaaga

SEQ ID NO: 810836 - DNA, 20 bp, Artificial
  CRISPR gRNA sequence
tattttctgattcctataga

SEQ ID NO: 810837 - DNA, 20 bp, Artificial
  CRISPR gRNA sequence
attttctgattcctatagag

SEQ ID NO: 810838 - DNA, 20 bp, Artificial
  CRISPR gRNA sequence
ttttctgattcctatagagc

SEQ ID NO: 810839 - DNA, 20 bp, Artificial
  CRISPR gRNA sequence
tctgattcctatagagcttg

SEQ ID NO: 810840 - DNA, 20 bp, Artificial
  CRISPR gRNA sequence
ctgattcctatagagcttgg

SEQ ID NO: 810841 - DNA, 20 bp, Artificial
  CRISPR gRNA sequence
tgattcctatagagcttggt

SEQ ID NO: 810842 - DNA, 20 bp, Artificial
  CRISPR gRNA sequence
attcctatagagcttggtac

SEQ ID NO: 810843 - DNA, 20 bp, Artificial
  CRISPR gRNA sequence
ctatagagcttggtacttca

SEQ ID NO: 810844 - DNA, 20 bp, Artificial
  CRISPR gRNA sequence
tagagcttggtacttcatgc

SEQ ID NO: 810845 - DNA, 20 bp, Artificial
  CRISPR gRNA sequence
ggtacttcatgccatgtgaa

SEQ ID NO: 810846 - DNA, 20 bp, Artificial
  CRISPR gRNA sequence
gtacttcatgccatgtgaaa

SEQ ID NO: 810847 - DNA, 20 bp, Artificial
  CRISPR gRNA sequence
catgccatgtgaaatgaata

SEQ ID NO: 810848 - DNA, 20 bp, Artificial
  CRISPR gRNA sequence
atgccatgtgaaatgaataa

SEQ ID NO: 810849 - DNA, 20 bp, Artificial
  CRISPR gRNA sequence
tcactatcaatattaagtaa

SEQ ID NO: 810850 - DNA, 20 bp, Artificial
  CRISPR gRNA sequence
tcaatattaagtaataatgg

SEQ ID NO: 810851 - DNA, 20 bp, Artificial
  CRISPR gRNA sequence
agtaataatggttatcattt

SEQ ID NO: 810852 - DNA, 20 bp, Artificial
  CRISPR gRNA sequence
tcatttgtaaacacattgta

SEQ ID NO: 810853 - DNA, 20 bp, Artificial
  CRISPR gRNA sequence
gtaaacacattgtatatccc

SEQ ID NO: 810854 - DNA, 20 bp, Artificial
  CRISPR gRNA sequence
taaacacattgtatatccct

SEQ ID NO: 810855 - DNA, 20 bp, Artificial
  CRISPR gRNA sequence
tatatccctgatatcatgct

SEQ ID NO: 810856 - DNA, 20 bp, Artificial
  CRISPR gRNA sequence
atatcatgctattttccaca

SEQ ID NO: 810857 - DNA, 20 bp, Artificial
  CRISPR gRNA sequence
ttttccacatatattgaatt

SEQ ID NO: 810858 - DNA, 20 bp, Artificial
  CRISPR gRNA sequence
tccacatatattgaattatt

SEQ ID NO: 810859 - DNA, 20 bp, Artificial
  CRISPR gRNA sequence
ccacatatattgaattattt

SEQ ID NO: 810860 - DNA, 20 bp, Artificial
  CRISPR gRNA sequence
cacatatattgaattattta

SEQ ID NO: 810861 - DNA, 20 bp, Artificial
  CRISPR gRNA sequence
aattatttaattcttacaat

SEQ ID NO: 810862 - DNA, 20 bp, Artificial
  CRISPR gRNA sequence
tttaattcttacaatgcaat

SEQ ID NO: 810863 - DNA, 20 bp, Artificial
  CRISPR gRNA sequence
aattcttacaatgcaataaa

SEQ ID NO: 810864 - DNA, 20 bp, Artificial
  CRISPR gRNA sequence
attcttacaatgcaataaag

SEQ ID NO: 810865 - DNA, 20 bp, Artificial
  CRISPR gRNA sequence
ttacaatgcaataaagatgg

SEQ ID NO: 810866 - DNA, 20 bp, Artificial
  CRISPR gRNA sequence
acaatgcaataaagatggca

SEQ ID NO: 810867 - DNA, 20 bp, Artificial
  CRISPR gRNA sequence
caatgcaataaagatggcat

SEQ ID NO: 810868 - DNA, 20 bp, Artificial
  CRISPR gRNA sequence
ttgatattcccaattcttgt

SEQ ID NO: 810869 - DNA, 20 bp, Artificial
  CRISPR gRNA sequence
atattcccaattcttgtgga

SEQ ID NO: 810870 - DNA, 20 bp, Artificial
  CRISPR gRNA sequence
ccaattcttgtggacggtta

SEQ ID NO: 810871 - DNA, 20 bp, Artificial
  CRISPR gRNA sequence
ttgtggacggttactgaaga

SEQ ID NO: 810872 - DNA, 20 bp, Artificial
  CRISPR gRNA sequence
gtggacggttactgaagata

SEQ ID NO: 810873 - DNA, 20 bp, Artificial
  CRISPR gRNA sequence
tggacggttactgaagatag

SEQ ID NO: 810874 - DNA, 20 bp, Artificial
  CRISPR gRNA sequence
ctgaagatagagaagttgag

SEQ ID NO: 810875 - DNA, 20 bp, Artificial
  CRISPR gRNA sequence
aagatagagaagttgagtgt

SEQ ID NO: 810876 - DNA, 20 bp, Artificial
  CRISPR gRNA sequence
agtgttttgttcatagtcat

SEQ ID NO: 810877 - DNA, 20 bp, Artificial
  CRISPR gRNA sequence
tgttcatagtcatagagctt

SEQ ID NO: 810878 - DNA, 20 bp, Artificial
  CRISPR gRNA sequence
gttcatagtcatagagctta

SEQ ID NO: 810879 - DNA, 20 bp, Artificial
  CRISPR gRNA sequence
ttcatagtcatagagcttat

SEQ ID NO: 810880 - DNA, 20 bp, Artificial
  CRISPR gRNA sequence
atagtcatagagcttataac

SEQ ID NO: 810881 - DNA, 20 bp, Artificial
  CRISPR gRNA sequence
ataactggtaggaccaatat

SEQ ID NO: 810882 - DNA, 20 bp, Artificial
  CRISPR gRNA sequence
taactggtaggaccaatatt

SEQ ID NO: 810883 - DNA, 20 bp, Artificial
  CRISPR gRNA sequence
gtaggaccaatatttgaaca

SEQ ID NO: 810884 - DNA, 20 bp, Artificial
  CRISPR gRNA sequence
gaacattggaattctgattc

SEQ ID NO: 810885 - DNA, 20 bp, Artificial
  CRISPR gRNA sequence
aacattggaattctgattcc

SEQ ID NO: 810886 - DNA, 20 bp, Artificial
  CRISPR gRNA sequence
gaattctgattccagacctc

SEQ ID NO: 810887 - DNA, 20 bp, Artificial
  CRISPR gRNA sequence
tgattccagacctcaacagt

SEQ ID NO: 810888 - DNA, 20 bp, Artificial
  CRISPR gRNA sequence
attccagacctcaacagtgg

SEQ ID NO: 810889 - DNA, 20 bp, Artificial
  CRISPR gRNA sequence
cagacctcaacagtggtcca

SEQ ID NO: 810890 - DNA, 20 bp, Artificial
  CRISPR gRNA sequence
aacagtggtccaagctacca

SEQ ID NO: 810891 - DNA, 20 bp, Artificial
  CRISPR gRNA sequence
ccacaatttgtggcttcttt

SEQ ID NO: 810892 - DNA, 20 bp, Artificial
  CRISPR gRNA sequence
gtggcttctttcttacagtg

SEQ ID NO: 810893 - DNA, 20 bp, Artificial
  CRISPR gRNA sequence
tggcttctttcttacagtgc

SEQ ID NO: 810894 - DNA, 20 bp, Artificial
  CRISPR gRNA sequence
ctttcttacagtgctataaa

SEQ ID NO: 810895 - DNA, 20 bp, Artificial
  CRISPR gRNA sequence
tttcttacagtgctataaat

SEQ ID NO: 810896 - DNA, 20 bp, Artificial
  CRISPR gRNA sequence
tcttacagtgctataaatta

SEQ ID NO: 810897 - DNA, 20 bp, Artificial
  CRISPR gRNA sequence
cttacagtgctataaattat

SEQ ID NO: 810898 - DNA, 20 bp, Artificial
  CRISPR gRNA sequence
ttacagtgctataaattatt

SEQ ID NO: 810899 - DNA, 20 bp, Artificial
  CRISPR gRNA sequence
acagtgctataaattatttc

SEQ ID NO: 810900 - DNA, 20 bp, Artificial
  CRISPR gRNA sequence
cagtgctataaattatttca

SEQ ID NO: 810901 - DNA, 20 bp, Artificial
  CRISPR gRNA sequence
taaattatttcacaattgga

SEQ ID NO: 810902 - DNA, 20 bp, Artificial
  CRISPR gRNA sequence
tttcacaattggaggccaga

SEQ ID NO: 810903 - DNA, 20 bp, Artificial
  CRISPR gRNA sequence
cacaattggaggccagaaag

SEQ ID NO: 810904 - DNA, 20 bp, Artificial
  CRISPR gRNA sequence
acaattggaggccagaaaga

SEQ ID NO: 810905 - DNA, 20 bp, Artificial
  CRISPR gRNA sequence
gaggccagaaagaggacgga

SEQ ID NO: 810906 - DNA, 20 bp, Artificial
  CRISPR gRNA sequence
gattacccactatctcactt

SEQ ID NO: 810907 - DNA, 20 bp, Artificial
  CRISPR gRNA sequence
cccactatctcactttattt

SEQ ID NO: 810908 - DNA, 20 bp, Artificial
  CRISPR gRNA sequence
tctcactttatttggtattt

SEQ ID NO: 810909 - DNA, 20 bp, Artificial
  CRISPR gRNA sequence
actttatttggtattttttc

SEQ ID NO: 810910 - DNA, 20 bp, Artificial
  CRISPR gRNA sequence
tatttggtattttttccaaa

SEQ ID NO: 810911 - DNA, 20 bp, Artificial
  CRISPR gRNA sequence
atttggtattttttccaaac

SEQ ID NO: 810912 - DNA, 20 bp, Artificial
  CRISPR gRNA sequence
tttggtattttttccaaaca

SEQ ID NO: 810913 - DNA, 20 bp, Artificial
  CRISPR gRNA sequence
ggtattttttccaaacatct

SEQ ID NO: 810914 - DNA, 20 bp, Artificial
  CRISPR gRNA sequence
gtattttttccaaacatctt

SEQ ID NO: 810915 - DNA, 20 bp, Artificial
  CRISPR gRNA sequence
tttccaaacatcttcaggca

SEQ ID NO: 810916 - DNA, 20 bp, Artificial
  CRISPR gRNA sequence
ttccaaacatcttcaggcaa

SEQ ID NO: 810917 - DNA, 20 bp, Artificial
  CRISPR gRNA sequence
tccaaacatcttcaggcaaa

SEQ ID NO: 810918 - DNA, 20 bp, Artificial
  CRISPR gRNA sequence
ccaaacatcttcaggcaaaa

SEQ ID NO: 810919 - DNA, 20 bp, Artificial
  CRISPR gRNA sequence
caaacatcttcaggcaaaaa

SEQ ID NO: 810920 - DNA, 20 bp, Artificial
  CRISPR gRNA sequence
caggcaaaaatttacttttt

SEQ ID NO: 810921 - DNA, 20 bp, Artificial
  CRISPR gRNA sequence
aggcaaaaatttacttttta

SEQ ID NO: 810922 - DNA, 20 bp, Artificial
  CRISPR gRNA sequence
actttttacttcctcctttc

SEQ ID NO: 810923 - DNA, 20 bp, Artificial
  CRISPR gRNA sequence
ctttttacttcctcctttcc

SEQ ID NO: 810924 - DNA, 20 bp, Artificial
  CRISPR gRNA sequence
tttacttcctcctttcctct

SEQ ID NO: 810925 - DNA, 20 bp, Artificial
  CRISPR gRNA sequence
ttacttcctcctttcctctg

SEQ ID NO: 810926 - DNA, 20 bp, Artificial
  CRISPR gRNA sequence
tacttcctcctttcctctgt

SEQ ID NO: 810927 - DNA, 20 bp, Artificial
  CRISPR gRNA sequence
acttcctcctttcctctgtt

SEQ ID NO: 810928 - DNA, 20 bp, Artificial
  CRISPR gRNA sequence
cttcctcctttcctctgttt

SEQ ID NO: 810929 - DNA, 20 bp, Artificial
  CRISPR gRNA sequence
cctcctttcctctgttttct

SEQ ID NO: 810930 - DNA, 20 bp, Artificial
  CRISPR gRNA sequence
ctcctttcctctgttttctt

SEQ ID NO: 810931 - DNA, 20 bp, Artificial
  CRISPR gRNA sequence
ctttcctctgttttctttga

SEQ ID NO: 810932 - DNA, 20 bp, Artificial
  CRISPR gRNA sequence
tcctctgttttctttgagat

SEQ ID NO: 810933 - DNA, 20 bp, Artificial
  CRISPR gRNA sequence
cctctgttttctttgagatt

SEQ ID NO: 810934 - DNA, 20 bp, Artificial
  CRISPR gRNA sequence
ctctgttttctttgagatta

SEQ ID NO: 810935 - DNA, 20 bp, Artificial
  CRISPR gRNA sequence
tgttttctttgagattaaga

SEQ ID NO: 810936 - DNA, 20 bp, Artificial
  CRISPR gRNA sequence
ttttctttgagattaagaag

SEQ ID NO: 810937 - DNA, 20 bp, Artificial
  CRISPR gRNA sequence
tctttgagattaagaagaga

SEQ ID NO: 810938 - DNA, 20 bp, Artificial
  CRISPR gRNA sequence
ctttgagattaagaagagaa

SEQ ID NO: 810939 - DNA, 20 bp, Artificial
  CRISPR gRNA sequence
tttgagattaagaagagaaa

SEQ ID NO: 810940 - DNA, 20 bp, Artificial
  CRISPR gRNA sequence
tgagattaagaagagaaaaa

SEQ ID NO: 810941 - DNA, 20 bp, Artificial
  CRISPR gRNA sequence
gagattaagaagagaaaaaa

SEQ ID NO: 810942 - DNA, 20 bp, Artificial
  CRISPR gRNA sequence
agattaagaagagaaaaaaa

SEQ ID NO: 810943 - DNA, 20 bp, Artificial
  CRISPR gRNA sequence
agaagagaaaaaaaataaag

SEQ ID NO: 810944 - DNA, 20 bp, Artificial
  CRISPR gRNA sequence
gataatgtctatacatagta

SEQ ID NO: 810945 - DNA, 20 bp, Artificial
  CRISPR gRNA sequence
tacatagtaaagagttgggt

SEQ ID NO: 810946 - DNA, 20 bp, Artificial
  CRISPR gRNA sequence
ggtatatttattctgcactt

SEQ ID NO: 810947 - DNA, 20 bp, Artificial
  CRISPR gRNA sequence
attctgcacttctccctaac

SEQ ID NO: 810948 - DNA, 20 bp, Artificial
  CRISPR gRNA sequence
ttctgcacttctccctaaca

SEQ ID NO: 810949 - DNA, 20 bp, Artificial
  CRISPR gRNA sequence
tgcacttctccctaacacat

SEQ ID NO: 810950 - DNA, 20 bp, Artificial
  CRISPR gRNA sequence
cacttctccctaacacatgc

SEQ ID NO: 810951 - DNA, 20 bp, Artificial
  CRISPR gRNA sequence
ctccctaacacatgcagata

SEQ ID NO: 810952 - DNA, 20 bp, Artificial
  CRISPR gRNA sequence
tccctaacacatgcagatac

SEQ ID NO: 810953 - DNA, 20 bp, Artificial
  CRISPR gRNA sequence
cctaacacatgcagatacat

SEQ ID NO: 810954 - DNA, 20 bp, Artificial
  CRISPR gRNA sequence
acacatgcagatacatacac

SEQ ID NO: 810955 - DNA, 20 bp, Artificial
  CRISPR gRNA sequence
atacacacacctgcttcttt

SEQ ID NO: 810956 - DNA, 20 bp, Artificial
  CRISPR gRNA sequence
cttctttgcagtatatgctg

SEQ ID NO: 810957 - DNA, 20 bp, Artificial
  CRISPR gRNA sequence
ctttgcagtatatgctgagt

SEQ ID NO: 810958 - DNA, 20 bp, Artificial
  CRISPR gRNA sequence
tttgcagtatatgctgagtg

SEQ ID NO: 810959 - DNA, 20 bp, Artificial
  CRISPR gRNA sequence
tgcagtatatgctgagtgaa

SEQ ID NO: 810960 - DNA, 20 bp, Artificial
  CRISPR gRNA sequence
gcagtatatgctgagtgaat

SEQ ID NO: 810961 - DNA, 20 bp, Artificial
  CRISPR gRNA sequence
cagtatatgctgagtgaatt

SEQ ID NO: 810962 - DNA, 20 bp, Artificial
  CRISPR gRNA sequence
agtgaattaaacagatatgg

SEQ ID NO: 810963 - DNA, 20 bp, Artificial
  CRISPR gRNA sequence
aacagatatggctccctgcc

SEQ ID NO: 810964 - DNA, 20 bp, Artificial
  CRISPR gRNA sequence
cctgcctcaagaaagctgag

SEQ ID NO: 810965 - DNA, 20 bp, Artificial
  CRISPR gRNA sequence
cctcaagaaagctgagatct

SEQ ID NO: 810966 - DNA, 20 bp, Artificial
  CRISPR gRNA sequence
aagaaagctgagatctaagt

SEQ ID NO: 810967 - DNA, 20 bp, Artificial
  CRISPR gRNA sequence
agatctaagtatagtcattt

SEQ ID NO: 810968 - DNA, 20 bp, Artificial
  CRISPR gRNA sequence
agtatagtcattttggaaaa

SEQ ID NO: 810969 - DNA, 20 bp, Artificial
  CRISPR gRNA sequence
tggaaaatagtatagaggtc

SEQ ID NO: 810970 - DNA, 20 bp, Artificial
  CRISPR gRNA sequence
ggaaaatagtatagaggtcc

SEQ ID NO: 810971 - DNA, 20 bp, Artificial
  CRISPR gRNA sequence
gaaaatagtatagaggtcct

SEQ ID NO: 810972 - DNA, 20 bp, Artificial
  CRISPR gRNA sequence
aaaaaactaaaaatagaatg

SEQ ID NO: 810973 - DNA, 20 bp, Artificial
  CRISPR gRNA sequence
aaaatagaatgaccacatga

SEQ ID NO: 810974 - DNA, 20 bp, Artificial
  CRISPR gRNA sequence
cttctgggtatatatccaaa

SEQ ID NO: 810975 - DNA, 20 bp, Artificial
  CRISPR gRNA sequence
ctgggtatatatccaaagga

SEQ ID NO: 810976 - DNA, 20 bp, Artificial
  CRISPR gRNA sequence
tgggtatatatccaaaggaa

SEQ ID NO: 810977 - DNA, 20 bp, Artificial
  CRISPR gRNA sequence
ggtatatatccaaaggaatt

SEQ ID NO: 810978 - DNA, 20 bp, Artificial
  CRISPR gRNA sequence
aatttagtatgttgaagaga

SEQ ID NO: 810979 - DNA, 20 bp, Artificial
  CRISPR gRNA sequence
agtatgttgaagagatatct

SEQ ID NO: 810980 - DNA, 20 bp, Artificial
  CRISPR gRNA sequence
gtatgttgaagagatatctg

SEQ ID NO: 810981 - DNA, 20 bp, Artificial
  CRISPR gRNA sequence
aagagatatctgtattcctt

SEQ ID NO: 810982 - DNA, 20 bp, Artificial
  CRISPR gRNA sequence
tattcctttattcatttcag

SEQ ID NO: 810983 - DNA, 20 bp, Artificial
  CRISPR gRNA sequence
ctttattcatttcagcatga

SEQ ID NO: 810984 - DNA, 20 bp, Artificial
  CRISPR gRNA sequence
tattcatttcagcatgattc

SEQ ID NO: 810985 - DNA, 20 bp, Artificial
  CRISPR gRNA sequence
attcatttcagcatgattca

SEQ ID NO: 810986 - DNA, 20 bp, Artificial
  CRISPR gRNA sequence
ttcatttcagcatgattcac

SEQ ID NO: 810987 - DNA, 20 bp, Artificial
  CRISPR gRNA sequence
atttcagcatgattcacaat

SEQ ID NO: 810988 - DNA, 20 bp, Artificial
  CRISPR gRNA sequence
cagcatgattcacaataacc

SEQ ID NO: 810989 - DNA, 20 bp, Artificial
  CRISPR gRNA sequence
agcatgattcacaataacca

SEQ ID NO: 810990 - DNA, 20 bp, Artificial
  CRISPR gRNA sequence
acaataaccaagatgtggaa

SEQ ID NO: 810991 - DNA, 20 bp, Artificial
  CRISPR gRNA sequence
aatgtccatcaacagagaat

SEQ ID NO: 810992 - DNA, 20 bp, Artificial
  CRISPR gRNA sequence
acagcccttagaaagaagta

SEQ ID NO: 810993 - DNA, 20 bp, Artificial
  CRISPR gRNA sequence
cagcccttagaaagaagtaa

SEQ ID NO: 810994 - DNA, 20 bp, Artificial
  CRISPR gRNA sequence
agaaagaagtaaaatctgtc

SEQ ID NO: 810995 - DNA, 20 bp, Artificial
  CRISPR gRNA sequence
gaaagaagtaaaatctgtca

SEQ ID NO: 810996 - DNA, 20 bp, Artificial
  CRISPR gRNA sequence
tcattcatgacaacatggat

SEQ ID NO: 810997 - DNA, 20 bp, Artificial
  CRISPR gRNA sequence
atgacaacatggatggaact

SEQ ID NO: 810998 - DNA, 20 bp, Artificial
  CRISPR gRNA sequence
aagggtattatgctaagtta

SEQ ID NO: 810999 - DNA, 20 bp, Artificial
  CRISPR gRNA sequence
tgctaagttaagtaagccag

SEQ ID NO: 811000 - DNA, 20 bp, Artificial
  CRISPR gRNA sequence
agttaagtaagccaggcaca

SEQ ID NO: 811001 - DNA, 20 bp, Artificial
  CRISPR gRNA sequence
agtaagccaggcacaaaaag

SEQ ID NO: 811002 - DNA, 20 bp, Artificial
  CRISPR gRNA sequence
atttatttgtgaaatctaaa

SEQ ID NO: 811003 - DNA, 20 bp, Artificial
  CRISPR gRNA sequence
atttgtgaaatctaaaaaag

SEQ ID NO: 811004 - DNA, 20 bp, Artificial
  CRISPR gRNA sequence
tttgtgaaatctaaaaaagt

SEQ ID NO: 811005 - DNA, 20 bp, Artificial
  CRISPR gRNA sequence
gtgaaatctaaaaaagtaga

SEQ ID NO: 811006 - DNA, 20 bp, Artificial
  CRISPR gRNA sequence
tgaaatctaaaaaagtagat

SEQ ID NO: 811007 - DNA, 20 bp, Artificial
  CRISPR gRNA sequence
aaaaagtagatcccatagaa

SEQ ID NO: 811008 - DNA, 20 bp, Artificial
  CRISPR gRNA sequence
tcagaggctggggatgtgga

SEQ ID NO: 811009 - DNA, 20 bp, Artificial
  CRISPR gRNA sequence
gggatgtggaagatgttgct

SEQ ID NO: 811010 - DNA, 20 bp, Artificial
  CRISPR gRNA sequence
ctcagtctcagagtagagga

SEQ ID NO: 811011 - DNA, 20 bp, Artificial
  CRISPR gRNA sequence
agtctcagagtagaggaaat

SEQ ID NO: 811012 - DNA, 20 bp, Artificial
  CRISPR gRNA sequence
agagtagaggaaatgtttta

SEQ ID NO: 811013 - DNA, 20 bp, Artificial
  CRISPR gRNA sequence
tagtgatctattgccatgtg

SEQ ID NO: 811014 - DNA, 20 bp, Artificial
  CRISPR gRNA sequence
agtgatctattgccatgtgt

SEQ ID NO: 811015 - DNA, 20 bp, Artificial
  CRISPR gRNA sequence
gtgatctattgccatgtgtg

SEQ ID NO: 811016 - DNA, 20 bp, Artificial
  CRISPR gRNA sequence
ttgccatgtgtgatgaccac

SEQ ID NO: 811017 - DNA, 20 bp, Artificial
  CRISPR gRNA sequence
ccatgtgtgatgaccacagt

SEQ ID NO: 811018 - DNA, 20 bp, Artificial
  CRISPR gRNA sequence
atgcattctgtattcaaatt

SEQ ID NO: 811019 - DNA, 20 bp, Artificial
  CRISPR gRNA sequence
tgtattcaaatttgctaaaa

SEQ ID NO: 811020 - DNA, 20 bp, Artificial
  CRISPR gRNA sequence
tattcaaatttgctaaaagc

SEQ ID NO: 811021 - DNA, 20 bp, Artificial
  CRISPR gRNA sequence
aaatttgctaaaagcatgaa

SEQ ID NO: 811022 - DNA, 20 bp, Artificial
  CRISPR gRNA sequence
gctaaaagcatgaatttttt

SEQ ID NO: 811023 - DNA, 20 bp, Artificial
  CRISPR gRNA sequence
ctaaaagcatgaatttttta

SEQ ID NO: 811024 - DNA, 20 bp, Artificial
  CRISPR gRNA sequence
aaagcatgaattttttacat

SEQ ID NO: 811025 - DNA, 20 bp, Artificial
  CRISPR gRNA sequence
tttacattctctgttttgag

SEQ ID NO: 811026 - DNA, 20 bp, Artificial
  CRISPR gRNA sequence
ttacattctctgttttgaga

SEQ ID NO: 811027 - DNA, 20 bp, Artificial
  CRISPR gRNA sequence
tacattctctgttttgagat

SEQ ID NO: 811028 - DNA, 20 bp, Artificial
  CRISPR gRNA sequence
acattctctgttttgagatt

SEQ ID NO: 811029 - DNA, 20 bp, Artificial
  CRISPR gRNA sequence
cattctctgttttgagatta

SEQ ID NO: 811030 - DNA, 20 bp, Artificial
  CRISPR gRNA sequence
tctgttttgagattaagaag

SEQ ID NO: 811031 - DNA, 20 bp, Artificial
  CRISPR gRNA sequence
tgttttgagattaagaagag

SEQ ID NO: 811032 - DNA, 20 bp, Artificial
  CRISPR gRNA sequence
ttttgagattaagaagagaa

SEQ ID NO: 811033 - DNA, 20 bp, Artificial
  CRISPR gRNA sequence
tgagattaagaagagaaaaa

SEQ ID NO: 811034 - DNA, 20 bp, Artificial
  CRISPR gRNA sequence
gagattaagaagagaaaaaa

SEQ ID NO: 811035 - DNA, 20 bp, Artificial
  CRISPR gRNA sequence
agattaagaagagaaaaaaa

SEQ ID NO: 811036 - DNA, 20 bp, Artificial
  CRISPR gRNA sequence
agaagagaaaaaaataaaga

SEQ ID NO: 811037 - DNA, 20 bp, Artificial
  CRISPR gRNA sequence
ggtgatgtgatatgttaact

SEQ ID NO: 811038 - DNA, 20 bp, Artificial
  CRISPR gRNA sequence
gtgatgtgatatgttaacta

SEQ ID NO: 811039 - DNA, 20 bp, Artificial
  CRISPR gRNA sequence
actagtttgatttattcttt

SEQ ID NO: 811040 - DNA, 20 bp, Artificial
  CRISPR gRNA sequence
gtttgatttattcttttttt

SEQ ID NO: 811041 - DNA, 20 bp, Artificial
  CRISPR gRNA sequence
gatttattcttttttttttt

SEQ ID NO: 811042 - DNA, 20 bp, Artificial
  CRISPR gRNA sequence
atttattctttttttttttt

SEQ ID NO: 811043 - DNA, 20 bp, Artificial
  CRISPR gRNA sequence
attctttttttttttttttt

SEQ ID NO: 811044 - DNA, 20 bp, Artificial
  CRISPR gRNA sequence
ttcttttttttttttttttt

SEQ ID NO: 811045 - DNA, 20 bp, Artificial
  CRISPR gRNA sequence
tttttttttttttttttttt

SEQ ID NO: 811046 - DNA, 20 bp, Artificial
  CRISPR gRNA sequence
tttttttttttttttttttg

SEQ ID NO: 811047 - DNA, 20 bp, Artificial
  CRISPR gRNA sequence
ttttttttttttttttttga

SEQ ID NO: 811048 - DNA, 20 bp, Artificial
  CRISPR gRNA sequence
tttttttttttttttttgag

SEQ ID NO: 811049 - DNA, 20 bp, Artificial
  CRISPR gRNA sequence
ttttttttttttttttgaga

SEQ ID NO: 811050 - DNA, 20 bp, Artificial
  CRISPR gRNA sequence
tttttttttttttttgagac

SEQ ID NO: 811051 - DNA, 20 bp, Artificial
  CRISPR gRNA sequence
ttttttttttttttgagaca

SEQ ID NO: 811052 - DNA, 20 bp, Artificial
  CRISPR gRNA sequence
tttttttttttttgagacag

SEQ ID NO: 811053 - DNA, 20 bp, Artificial
  CRISPR gRNA sequence
ttttttttttttgagacaga

SEQ ID NO: 811054 - DNA, 20 bp, Artificial
  CRISPR gRNA sequence
tttttttttttgagacagag

SEQ ID NO: 811055 - DNA, 20 bp, Artificial
  CRISPR gRNA sequence
ttttttttttgagacagagt

SEQ ID NO: 811056 - DNA, 20 bp, Artificial
  CRISPR gRNA sequence
tttttttttgagacagagtt

SEQ ID NO: 811057 - DNA, 20 bp, Artificial
  CRISPR gRNA sequence
ttttttttgagacagagttt

SEQ ID NO: 811058 - DNA, 20 bp, Artificial
  CRISPR gRNA sequence
tttttttgagacagagtttc

SEQ ID NO: 811059 - DNA, 20 bp, Artificial
  CRISPR gRNA sequence
ttttttgagacagagtttcg

SEQ ID NO: 811060 - DNA, 20 bp, Artificial
  CRISPR gRNA sequence
tttttgagacagagtttcgc

SEQ ID NO: 811061 - DNA, 20 bp, Artificial
  CRISPR gRNA sequence
ttttgagacagagtttcgct

SEQ ID NO: 811062 - DNA, 20 bp, Artificial
  CRISPR gRNA sequence
tttgagacagagtttcgctc

SEQ ID NO: 811063 - DNA, 20 bp, Artificial
  CRISPR gRNA sequence
ttgagacagagtttcgctcg

SEQ ID NO: 811064 - DNA, 20 bp, Artificial
  CRISPR gRNA sequence
tgagacagagtttcgctcgt

SEQ ID NO: 811065 - DNA, 20 bp, Artificial
  CRISPR gRNA sequence
gagacagagtttcgctcgtc

SEQ ID NO: 811066 - DNA, 20 bp, Artificial
  CRISPR gRNA sequence
agacagagtttcgctcgtca

SEQ ID NO: 811067 - DNA, 20 bp, Artificial
  CRISPR gRNA sequence
cgctcgtcacccaggctgga

SEQ ID NO: 811068 - DNA, 20 bp, Artificial
  CRISPR gRNA sequence
gctcgtcacccaggctggag

SEQ ID NO: 811069 - DNA, 20 bp, Artificial
  CRISPR gRNA sequence
gtcacccaggctggagtgca

SEQ ID NO: 811070 - DNA, 20 bp, Artificial
  CRISPR gRNA sequence
gagtgcaacagcgtgatctc

SEQ ID NO: 811071 - DNA, 20 bp, Artificial
  CRISPR gRNA sequence
ggctcactgcaacctccacc

SEQ ID NO: 811072 - DNA, 20 bp, Artificial
  CRISPR gRNA sequence
actgcaacctccacctccca

SEQ ID NO: 811073 - DNA, 20 bp, Artificial
  CRISPR gRNA sequence
caacctccacctcccaggtt

SEQ ID NO: 811074 - DNA, 20 bp, Artificial
  CRISPR gRNA sequence
cacctcccaggttcaagcaa

SEQ ID NO: 811075 - DNA, 20 bp, Artificial
  CRISPR gRNA sequence
ccaggttcaagcaattctcc

SEQ ID NO: 811076 - DNA, 20 bp, Artificial
  CRISPR gRNA sequence
aagcaattctcctgcctcag

SEQ ID NO: 811077 - DNA, 20 bp, Artificial
  CRISPR gRNA sequence
tcctgcctcagcttcctgag

SEQ ID NO: 811078 - DNA, 20 bp, Artificial
  CRISPR gRNA sequence
ctgcctcagcttcctgagta

SEQ ID NO: 811079 - DNA, 20 bp, Artificial
  CRISPR gRNA sequence
cctcagcttcctgagtagct

SEQ ID NO: 811080 - DNA, 20 bp, Artificial
  CRISPR gRNA sequence
agcttcctgagtagctggga

SEQ ID NO: 811081 - DNA, 20 bp, Artificial
  CRISPR gRNA sequence
cctgagtagctgggattgca

SEQ ID NO: 811082 - DNA, 20 bp, Artificial
  CRISPR gRNA sequence
ctgagtagctgggattgcag

SEQ ID NO: 811083 - DNA, 20 bp, Artificial
  CRISPR gRNA sequence
agtagctgggattgcaggca

SEQ ID NO: 811084 - DNA, 20 bp, Artificial
  CRISPR gRNA sequence
ggattgcaggcacctgccac

SEQ ID NO: 811085 - DNA, 20 bp, Artificial
  CRISPR gRNA sequence
caggcacctgccaccatgcc

SEQ ID NO: 811086 - DNA, 20 bp, Artificial
  CRISPR gRNA sequence
ccaccatgcctggctaattt

SEQ ID NO: 811087 - DNA, 20 bp, Artificial
  CRISPR gRNA sequence
gctaattttttctattttca

SEQ ID NO: 811088 - DNA, 20 bp, Artificial
  CRISPR gRNA sequence
attttttctattttcagtag

SEQ ID NO: 811089 - DNA, 20 bp, Artificial
  CRISPR gRNA sequence
tttctattttcagtagagat

SEQ ID NO: 811090 - DNA, 20 bp, Artificial
  CRISPR gRNA sequence
ttctattttcagtagagatg

SEQ ID NO: 811091 - DNA, 20 bp, Artificial
  CRISPR gRNA sequence
tctattttcagtagagatgg

SEQ ID NO: 811092 - DNA, 20 bp, Artificial
  CRISPR gRNA sequence
ctattttcagtagagatggg

SEQ ID NO: 811093 - DNA, 20 bp, Artificial
  CRISPR gRNA sequence
tattttcagtagagatgggg

SEQ ID NO: 811094 - DNA, 20 bp, Artificial
  CRISPR gRNA sequence
ttttcagtagagatggggtt

SEQ ID NO: 811095 - DNA, 20 bp, Artificial
  CRISPR gRNA sequence
tcagtagagatggggtttca

SEQ ID NO: 811096 - DNA, 20 bp, Artificial
  CRISPR gRNA sequence
cagtagagatggggtttcac

SEQ ID NO: 811097 - DNA, 20 bp, Artificial
  CRISPR gRNA sequence
agtagagatggggtttcacc

SEQ ID NO: 811098 - DNA, 20 bp, Artificial
  CRISPR gRNA sequence
caccatgttggtcagcctgg

SEQ ID NO: 811099 - DNA, 20 bp, Artificial
  CRISPR gRNA sequence
accatgttggtcagcctggt

SEQ ID NO: 811100 - DNA, 20 bp, Artificial
  CRISPR gRNA sequence
gtcagcctggttttgaactc

SEQ ID NO: 811101 - DNA, 20 bp, Artificial
  CRISPR gRNA sequence
gttttgaactcctgacctca

SEQ ID NO: 811102 - DNA, 20 bp, Artificial
  CRISPR gRNA sequence
tgaactcctgacctcaggtg

SEQ ID NO: 811103 - DNA, 20 bp, Artificial
  CRISPR gRNA sequence
gaactcctgacctcaggtga

SEQ ID NO: 811104 - DNA, 20 bp, Artificial
  CRISPR gRNA sequence
aactcctgacctcaggtgat

SEQ ID NO: 811105 - DNA, 20 bp, Artificial
  CRISPR gRNA sequence
ctgacctcaggtgatccacc

SEQ ID NO: 811106 - DNA, 20 bp, Artificial
  CRISPR gRNA sequence
acctcaggtgatccacctgc

SEQ ID NO: 811107 - DNA, 20 bp, Artificial
  CRISPR gRNA sequence
aggtgatccacctgccttgg

SEQ ID NO: 811108 - DNA, 20 bp, Artificial
  CRISPR gRNA sequence
ccttggcctcccaaagtgct

SEQ ID NO: 811109 - DNA, 20 bp, Artificial
  CRISPR gRNA sequence
ggcctcccaaagtgctggga

SEQ ID NO: 811110 - DNA, 20 bp, Artificial
  CRISPR gRNA sequence
gcctcccaaagtgctgggat

SEQ ID NO: 811111 - DNA, 20 bp, Artificial
  CRISPR gRNA sequence
ccaaagtgctgggattacag

SEQ ID NO: 811112 - DNA, 20 bp, Artificial
  CRISPR gRNA sequence
ggattacaggcatgagccac

SEQ ID NO: 811113 - DNA, 20 bp, Artificial
  CRISPR gRNA sequence
caggcatgagccactgtgcc

SEQ ID NO: 811114 - DNA, 20 bp, Artificial
  CRISPR gRNA sequence
tgcccggcttgattgactct

SEQ ID NO: 811115 - DNA, 20 bp, Artificial
  CRISPR gRNA sequence
gattgactctttctataatc

SEQ ID NO: 811116 - DNA, 20 bp, Artificial
  CRISPR gRNA sequence
attgactctttctataatct

SEQ ID NO: 811117 - DNA, 20 bp, Artificial
  CRISPR gRNA sequence
actctttctataatctatac

SEQ ID NO: 811118 - DNA, 20 bp, Artificial
  CRISPR gRNA sequence
tttctataatctatacatag

SEQ ID NO: 811119 - DNA, 20 bp, Artificial
  CRISPR gRNA sequence
tctataatctatacatagat

SEQ ID NO: 811120 - DNA, 20 bp, Artificial
  CRISPR gRNA sequence
ctataatctatacatagatc

SEQ ID NO: 811121 - DNA, 20 bp, Artificial
  CRISPR gRNA sequence
tataatctatacatagatca

SEQ ID NO: 811122 - DNA, 20 bp, Artificial
  CRISPR gRNA sequence
taatctatacatagatcaaa

SEQ ID NO: 811123 - DNA, 20 bp, Artificial
  CRISPR gRNA sequence
tacatagatcaaaacatcat

SEQ ID NO: 811124 - DNA, 20 bp, Artificial
  CRISPR gRNA sequence
taccccataaatatacatta

SEQ ID NO: 811125 - DNA, 20 bp, Artificial
  CRISPR gRNA sequence
ttgccagttaaaaataaatt

SEQ ID NO: 811126 - DNA, 20 bp, Artificial
  CRISPR gRNA sequence
ccagttaaaaataaatttta

SEQ ID NO: 811127 - DNA, 20 bp, Artificial
  CRISPR gRNA sequence
aaaataaattttaaaattaa

SEQ ID NO: 811128 - DNA, 20 bp, Artificial
  CRISPR gRNA sequence
taaaattaaaataaaacatt

SEQ ID NO: 811129 - DNA, 20 bp, Artificial
  CRISPR gRNA sequence
aaaattaaaataaaacatta

SEQ ID NO: 811130 - DNA, 20 bp, Artificial
  CRISPR gRNA sequence
aaattaaaataaaacattac

SEQ ID NO: 811131 - DNA, 20 bp, Artificial
  CRISPR gRNA sequence
aaataaaacattacaacctt

SEQ ID NO: 811132 - DNA, 20 bp, Artificial
  CRISPR gRNA sequence
caaccttataaaaactttaa

SEQ ID NO: 811133 - DNA, 20 bp, Artificial
  CRISPR gRNA sequence
ataaaaactttaaaaataag

SEQ ID NO: 811134 - DNA, 20 bp, Artificial
  CRISPR gRNA sequence
taaaaactttaaaaataagt

SEQ ID NO: 811135 - DNA, 20 bp, Artificial
  CRISPR gRNA sequence
taaaaataagtaaaataggc

SEQ ID NO: 811136 - DNA, 20 bp, Artificial
  CRISPR gRNA sequence
aaaaataagtaaaataggca

SEQ ID NO: 811137 - DNA, 20 bp, Artificial
  CRISPR gRNA sequence
aaaataagtaaaataggcat

SEQ ID NO: 811138 - DNA, 20 bp, Artificial
  CRISPR gRNA sequence
caagagactagaagacacaa

SEQ ID NO: 811139 - DNA, 20 bp, Artificial
  CRISPR gRNA sequence
gaagacacaagaacaaacct

SEQ ID NO: 811140 - DNA, 20 bp, Artificial
  CRISPR gRNA sequence
ccagtggtcttagataatag

SEQ ID NO: 811141 - DNA, 20 bp, Artificial
  CRISPR gRNA sequence
cagtggtcttagataatagc

SEQ ID NO: 811142 - DNA, 20 bp, Artificial
  CRISPR gRNA sequence
agataatagctaaaaataaa

SEQ ID NO: 811143 - DNA, 20 bp, Artificial
  CRISPR gRNA sequence
gataatagctaaaaataaac

SEQ ID NO: 811144 - DNA, 20 bp, Artificial
  CRISPR gRNA sequence
aaaataaacaaatatcaata

SEQ ID NO: 811145 - DNA, 20 bp, Artificial
  CRISPR gRNA sequence
ccaggcagtgtggaaagtca

SEQ ID NO: 811146 - DNA, 20 bp, Artificial
  CRISPR gRNA sequence
ttgatatttggtgagaggaa

SEQ ID NO: 811147 - DNA, 20 bp, Artificial
  CRISPR gRNA sequence
atatttggtgagaggaagag

SEQ ID NO: 811148 - DNA, 20 bp, Artificial
  CRISPR gRNA sequence
ggtgagaggaagaggggatg

SEQ ID NO: 811149 - DNA, 20 bp, Artificial
  CRISPR gRNA sequence
gtgagaggaagaggggatga

SEQ ID NO: 811150 - DNA, 20 bp, Artificial
  CRISPR gRNA sequence
gcttccattcggtaggaaat

SEQ ID NO: 811151 - DNA, 20 bp, Artificial
  CRISPR gRNA sequence
ccattcggtaggaaatattc

SEQ ID NO: 811152 - DNA, 20 bp, Artificial
  CRISPR gRNA sequence
cattcggtaggaaatattct

SEQ ID NO: 811153 - DNA, 20 bp, Artificial
  CRISPR gRNA sequence
ggtaggaaatattcttttaa

SEQ ID NO: 811154 - DNA, 20 bp, Artificial
  CRISPR gRNA sequence
ttttaagaaattaaatttca

SEQ ID NO: 811155 - DNA, 20 bp, Artificial
  CRISPR gRNA sequence
ttaagaaattaaatttcaat

SEQ ID NO: 811156 - DNA, 20 bp, Artificial
  CRISPR gRNA sequence
taagaaattaaatttcaata

SEQ ID NO: 811157 - DNA, 20 bp, Artificial
  CRISPR gRNA sequence
aagaaattaaatttcaatac

SEQ ID NO: 811158 - DNA, 20 bp, Artificial
  CRISPR gRNA sequence
agaaattaaatttcaataca

SEQ ID NO: 811159 - DNA, 20 bp, Artificial
  CRISPR gRNA sequence
aatttcaatacaatttttga

SEQ ID NO: 811160 - DNA, 20 bp, Artificial
  CRISPR gRNA sequence
caatacaatttttgaagtaa

SEQ ID NO: 811161 - DNA, 20 bp, Artificial
  CRISPR gRNA sequence
aatacaatttttgaagtaag

SEQ ID NO: 811162 - DNA, 20 bp, Artificial
  CRISPR gRNA sequence
ttgaagtaagtgtagtcttg

SEQ ID NO: 811163 - DNA, 20 bp, Artificial
  CRISPR gRNA sequence
tgaagtaagtgtagtcttga

SEQ ID NO: 811164 - DNA, 20 bp, Artificial
  CRISPR gRNA sequence
gaagtaagtgtagtcttgaa

SEQ ID NO: 811165 - DNA, 20 bp, Artificial
  CRISPR gRNA sequence
aagtaagtgtagtcttgaag

SEQ ID NO: 811166 - DNA, 20 bp, Artificial
  CRISPR gRNA sequence
gaagtaaaggcagaggtgtg

SEQ ID NO: 811167 - DNA, 20 bp, Artificial
  CRISPR gRNA sequence
aagtaaaggcagaggtgtga

SEQ ID NO: 811168 - DNA, 20 bp, Artificial
  CRISPR gRNA sequence
ttttctcctaaattgttgga

SEQ ID NO: 811169 - DNA, 20 bp, Artificial
  CRISPR gRNA sequence
tttctcctaaattgttggaa

SEQ ID NO: 811170 - DNA, 20 bp, Artificial
  CRISPR gRNA sequence
ttctcctaaattgttggaag

SEQ ID NO: 811171 - DNA, 20 bp, Artificial
  CRISPR gRNA sequence
tctcctaaattgttggaagt

SEQ ID NO: 811172 - DNA, 20 bp, Artificial
  CRISPR gRNA sequence
ctcctaaattgttggaagta

SEQ ID NO: 811173 - DNA, 20 bp, Artificial
  CRISPR gRNA sequence
tcctaaattgttggaagtat

SEQ ID NO: 811174 - DNA, 20 bp, Artificial
  CRISPR gRNA sequence
ctaaattgttggaagtataa

SEQ ID NO: 811175 - DNA, 20 bp, Artificial
  CRISPR gRNA sequence
aattgttggaagtataaata

SEQ ID NO: 811176 - DNA, 20 bp, Artificial
  CRISPR gRNA sequence
ttggaagtataaataggtac

SEQ ID NO: 811177 - DNA, 20 bp, Artificial
  CRISPR gRNA sequence
gaagtataaataggtacaaa

SEQ ID NO: 811178 - DNA, 20 bp, Artificial
  CRISPR gRNA sequence
tgtgaaaaacaatttcacat

SEQ ID NO: 811179 - DNA, 20 bp, Artificial
  CRISPR gRNA sequence
gtgaaaaacaatttcacatt

SEQ ID NO: 811180 - DNA, 20 bp, Artificial
  CRISPR gRNA sequence
tgaaaaacaatttcacatta

SEQ ID NO: 811181 - DNA, 20 bp, Artificial
  CRISPR gRNA sequence
cacattaaaataatggtaac

SEQ ID NO: 811182 - DNA, 20 bp, Artificial
  CRISPR gRNA sequence
acattaaaataatggtaaca

SEQ ID NO: 811183 - DNA, 20 bp, Artificial
  CRISPR gRNA sequence
aaataatggtaacaaccatg

SEQ ID NO: 811184 - DNA, 20 bp, Artificial
  CRISPR gRNA sequence
atgtgtatgatttacttatt

SEQ ID NO: 811185 - DNA, 20 bp, Artificial
  CRISPR gRNA sequence
acttattgttttctatgtgt

SEQ ID NO: 811186 - DNA, 20 bp, Artificial
  CRISPR gRNA sequence
cttattgttttctatgtgtt

SEQ ID NO: 811187 - DNA, 20 bp, Artificial
  CRISPR gRNA sequence
attgttttctatgtgttgag

SEQ ID NO: 811188 - DNA, 20 bp, Artificial
  CRISPR gRNA sequence
ttgttttctatgtgttgagc

SEQ ID NO: 811189 - DNA, 20 bp, Artificial
  CRISPR gRNA sequence
ttttctatgtgttgagcttt

SEQ ID NO: 811190 - DNA, 20 bp, Artificial
  CRISPR gRNA sequence
tctatgtgttgagctttgtg

SEQ ID NO: 811191 - DNA, 20 bp, Artificial
  CRISPR gRNA sequence
ctatgtgttgagctttgtgc

SEQ ID NO: 811192 - DNA, 20 bp, Artificial
  CRISPR gRNA sequence
tatgtgttgagctttgtgcc

SEQ ID NO: 811193 - DNA, 20 bp, Artificial
  CRISPR gRNA sequence
tgtgttgagctttgtgccac

SEQ ID NO: 811194 - DNA, 20 bp, Artificial
  CRISPR gRNA sequence
agctttgtgccacgtccttt

SEQ ID NO: 811195 - DNA, 20 bp, Artificial
  CRISPR gRNA sequence
tgtgccacgtccttttacat

SEQ ID NO: 811196 - DNA, 20 bp, Artificial
  CRISPR gRNA sequence
gtgccacgtccttttacatc

SEQ ID NO: 811197 - DNA, 20 bp, Artificial
  CRISPR gRNA sequence
tgccacgtccttttacatcc

SEQ ID NO: 811198 - DNA, 20 bp, Artificial
  CRISPR gRNA sequence
ttacatcctatggaagagaa

SEQ ID NO: 811199 - DNA, 20 bp, Artificial
  CRISPR gRNA sequence
tacatcctatggaagagaag

SEQ ID NO: 811200 - DNA, 20 bp, Artificial
  CRISPR gRNA sequence
acatcctatggaagagaagg

SEQ ID NO: 811201 - DNA, 20 bp, Artificial
  CRISPR gRNA sequence
catcctatggaagagaagga

SEQ ID NO: 811202 - DNA, 20 bp, Artificial
  CRISPR gRNA sequence
tggaagagaaggaatgttca

SEQ ID NO: 811203 - DNA, 20 bp, Artificial
  CRISPR gRNA sequence
atgccgttcttcacaatttt

SEQ ID NO: 811204 - DNA, 20 bp, Artificial
  CRISPR gRNA sequence
ttcacaatttttgcccctct

SEQ ID NO: 811205 - DNA, 20 bp, Artificial
  CRISPR gRNA sequence
cacaatttttgcccctctgt

SEQ ID NO: 811206 - DNA, 20 bp, Artificial
  CRISPR gRNA sequence
acaatttttgcccctctgtt

SEQ ID NO: 811207 - DNA, 20 bp, Artificial
  CRISPR gRNA sequence
ttgcccctctgttcccctcc

SEQ ID NO: 811208 - DNA, 20 bp, Artificial
  CRISPR gRNA sequence
tgcccctctgttcccctcct

SEQ ID NO: 811209 - DNA, 20 bp, Artificial
  CRISPR gRNA sequence
gcccctctgttcccctcctg

SEQ ID NO: 811210 - DNA, 20 bp, Artificial
  CRISPR gRNA sequence
cccctctgttcccctcctgt

SEQ ID NO: 811211 - DNA, 20 bp, Artificial
  CRISPR gRNA sequence
tgttcccctcctgtgttgtg

SEQ ID NO: 811212 - DNA, 20 bp, Artificial
  CRISPR gRNA sequence
ttcccctcctgtgttgtggg

SEQ ID NO: 811213 - DNA, 20 bp, Artificial
  CRISPR gRNA sequence
ccctcctgtgttgtgggtct

SEQ ID NO: 811214 - DNA, 20 bp, Artificial
  CRISPR gRNA sequence
ctgtgttgtgggtctcaatg

SEQ ID NO: 811215 - DNA, 20 bp, Artificial
  CRISPR gRNA sequence
tgttgtgggtctcaatgtta

SEQ ID NO: 811216 - DNA, 20 bp, Artificial
  CRISPR gRNA sequence
tgggtctcaatgttaagagt

SEQ ID NO: 811217 - DNA, 20 bp, Artificial
  CRISPR gRNA sequence
aatgttaagagttgacaatt

SEQ ID NO: 811218 - DNA, 20 bp, Artificial
  CRISPR gRNA sequence
agagttgacaatttgattca

SEQ ID NO: 811219 - DNA, 20 bp, Artificial
  CRISPR gRNA sequence
acaatttgattcattatagc

SEQ ID NO: 811220 - DNA, 20 bp, Artificial
  CRISPR gRNA sequence
gattcattatagcaaacaac

SEQ ID NO: 811221 - DNA, 20 bp, Artificial
  CRISPR gRNA sequence
attcattatagcaaacaaca

SEQ ID NO: 811222 - DNA, 20 bp, Artificial
  CRISPR gRNA sequence
attatagcaaacaacaccca

SEQ ID NO: 811223 - DNA, 20 bp, Artificial
  CRISPR gRNA sequence
tagcaaacaacacccactag

SEQ ID NO: 811224 - DNA, 20 bp, Artificial
  CRISPR gRNA sequence
gatctgggttcactagagag

SEQ ID NO: 811225 - DNA, 20 bp, Artificial
  CRISPR gRNA sequence
ggttcactagagagcagggt

SEQ ID NO: 811226 - DNA, 20 bp, Artificial
  CRISPR gRNA sequence
actagagagcagggtcactg

SEQ ID NO: 811227 - DNA, 20 bp, Artificial
  CRISPR gRNA sequence
gagagcagggtcactgcaca

SEQ ID NO: 811228 - DNA, 20 bp, Artificial
  CRISPR gRNA sequence
cacaatgaaacatccaccag

SEQ ID NO: 811229 - DNA, 20 bp, Artificial
  CRISPR gRNA sequence
cgtgcactttggctctccct

SEQ ID NO: 811230 - DNA, 20 bp, Artificial
  CRISPR gRNA sequence
tggctctcccttgaagttct

SEQ ID NO: 811231 - DNA, 20 bp, Artificial
  CRISPR gRNA sequence
ggctctcccttgaagttctc

SEQ ID NO: 811232 - DNA, 20 bp, Artificial
  CRISPR gRNA sequence
gctctcccttgaagttctcg

SEQ ID NO: 811233 - DNA, 20 bp, Artificial
  CRISPR gRNA sequence
tcccttgaagttctcgtctc

SEQ ID NO: 811234 - DNA, 20 bp, Artificial
  CRISPR gRNA sequence
ccttgaagttctcgtctcca

SEQ ID NO: 811235 - DNA, 20 bp, Artificial
  CRISPR gRNA sequence
gaagttctcgtctccatgtg

SEQ ID NO: 811236 - DNA, 20 bp, Artificial
  CRISPR gRNA sequence
aagttctcgtctccatgtgg

SEQ ID NO: 811237 - DNA, 20 bp, Artificial
  CRISPR gRNA sequence
tcgtctccatgtggtcagca

SEQ ID NO: 811238 - DNA, 20 bp, Artificial
  CRISPR gRNA sequence
gtctccatgtggtcagcaca

SEQ ID NO: 811239 - DNA, 20 bp, Artificial
  CRISPR gRNA sequence
catgtggtcagcacacccag

SEQ ID NO: 811240 - DNA, 20 bp, Artificial
  CRISPR gRNA sequence
ggcctcctggtatgtcccaa

SEQ ID NO: 811241 - DNA, 20 bp, Artificial
  CRISPR gRNA sequence
ctggtatgtcccaaaaagct

SEQ ID NO: 811242 - DNA, 20 bp, Artificial
  CRISPR gRNA sequence
gtatgtcccaaaaagctctg

SEQ ID NO: 811243 - DNA, 20 bp, Artificial
  CRISPR gRNA sequence
tgacatctttccccctaatg

SEQ ID NO: 811244 - DNA, 20 bp, Artificial
  CRISPR gRNA sequence
acatctttccccctaatgta

SEQ ID NO: 811245 - DNA, 20 bp, Artificial
  CRISPR gRNA sequence
tccccctaatgtataaatat

SEQ ID NO: 811246 - DNA, 20 bp, Artificial
  CRISPR gRNA sequence
ccccctaatgtataaatata

SEQ ID NO: 811247 - DNA, 20 bp, Artificial
  CRISPR gRNA sequence
cccctaatgtataaatatac

SEQ ID NO: 811248 - DNA, 20 bp, Artificial
  CRISPR gRNA sequence
atgtataaatatacataata

SEQ ID NO: 811249 - DNA, 20 bp, Artificial
  CRISPR gRNA sequence
tgtcatttaaatgatatgca

SEQ ID NO: 811250 - DNA, 20 bp, Artificial
  CRISPR gRNA sequence
aaatgatatgcagaccctat

SEQ ID NO: 811251 - DNA, 20 bp, Artificial
  CRISPR gRNA sequence
aatgatatgcagaccctatg

SEQ ID NO: 811252 - DNA, 20 bp, Artificial
  CRISPR gRNA sequence
tgaggtgggtaaaattcata

SEQ ID NO: 811253 - DNA, 20 bp, Artificial
  CRISPR gRNA sequence
atattactattttgtaatgc

SEQ ID NO: 811254 - DNA, 20 bp, Artificial
  CRISPR gRNA sequence
ctattttgtaatgcattctt

SEQ ID NO: 811255 - DNA, 20 bp, Artificial
  CRISPR gRNA sequence
ttttgtaatgcattcttaat

SEQ ID NO: 811256 - DNA, 20 bp, Artificial
  CRISPR gRNA sequence
tgtaatgcattcttaattgg

SEQ ID NO: 811257 - DNA, 20 bp, Artificial
  CRISPR gRNA sequence
gtaatgcattcttaattgga

SEQ ID NO: 811258 - DNA, 20 bp, Artificial
  CRISPR gRNA sequence
taatgcattcttaattggaa

SEQ ID NO: 811259 - DNA, 20 bp, Artificial
  CRISPR gRNA sequence
ttaattggaatcaccataag

SEQ ID NO: 811260 - DNA, 20 bp, Artificial
  CRISPR gRNA sequence
aattggaatcaccataagag

SEQ ID NO: 811261 - DNA, 20 bp, Artificial
  CRISPR gRNA sequence
attggaatcaccataagagg

SEQ ID NO: 811262 - DNA, 20 bp, Artificial
  CRISPR gRNA sequence
gaatcaccataagaggatgt

SEQ ID NO: 811263 - DNA, 20 bp, Artificial
  CRISPR gRNA sequence
tgtgtaattgcagatgtcta

SEQ ID NO: 811264 - DNA, 20 bp, Artificial
  CRISPR gRNA sequence
tgtaattgcagatgtctagg

SEQ ID NO: 811265 - DNA, 20 bp, Artificial
  CRISPR gRNA sequence
cagatgtctagggatggtgc

SEQ ID NO: 811266 - DNA, 20 bp, Artificial
  CRISPR gRNA sequence
gggatggtgcaacataagca

SEQ ID NO: 811267 - DNA, 20 bp, Artificial
  CRISPR gRNA sequence
tgaggttcttaggagcaccc

SEQ ID NO: 811268 - DNA, 20 bp, Artificial
  CRISPR gRNA sequence
aggttcttaggagcacccag

SEQ ID NO: 811269 - DNA, 20 bp, Artificial
  CRISPR gRNA sequence
ttaggagcacccagcagtag

SEQ ID NO: 811270 - DNA, 20 bp, Artificial
  CRISPR gRNA sequence
aggagcacccagcagtagta

SEQ ID NO: 811271 - DNA, 20 bp, Artificial
  CRISPR gRNA sequence
ggagcacccagcagtagtag

SEQ ID NO: 811272 - DNA, 20 bp, Artificial
  CRISPR gRNA sequence
agacactgaagcagcctact

SEQ ID NO: 811273 - DNA, 20 bp, Artificial
  CRISPR gRNA sequence
aagcagcctactgaaggact

SEQ ID NO: 811274 - DNA, 20 bp, Artificial
  CRISPR gRNA sequence
ctgaaggacttgacctgtta

SEQ ID NO: 811275 - DNA, 20 bp, Artificial
  CRISPR gRNA sequence
aaggacttgacctgttagac

SEQ ID NO: 811276 - DNA, 20 bp, Artificial
  CRISPR gRNA sequence
gacctgttagactcaccaat

SEQ ID NO: 811277 - DNA, 20 bp, Artificial
  CRISPR gRNA sequence
acctgttagactcaccaatc

SEQ ID NO: 811278 - DNA, 20 bp, Artificial
  CRISPR gRNA sequence
ttagactcaccaatctcctt

SEQ ID NO: 811279 - DNA, 20 bp, Artificial
  CRISPR gRNA sequence
gactcaccaatctccttgaa

SEQ ID NO: 811280 - DNA, 20 bp, Artificial
  CRISPR gRNA sequence
accaatctccttgaagccaa

SEQ ID NO: 811281 - DNA, 20 bp, Artificial
  CRISPR gRNA sequence
cttgaagccaaaactttggc

SEQ ID NO: 811282 - DNA, 20 bp, Artificial
  CRISPR gRNA sequence
gaagccaaaactttggccta

SEQ ID NO: 811283 - DNA, 20 bp, Artificial
  CRISPR gRNA sequence
aagccaaaactttggcctat

SEQ ID NO: 811284 - DNA, 20 bp, Artificial
  CRISPR gRNA sequence
tggcctatctttcataatca

SEQ ID NO: 811285 - DNA, 20 bp, Artificial
  CRISPR gRNA sequence
ggcctatctttcataatcaa

SEQ ID NO: 811286 - DNA, 20 bp, Artificial
  CRISPR gRNA sequence
gcctatctttcataatcaaa

SEQ ID NO: 811287 - DNA, 20 bp, Artificial
  CRISPR gRNA sequence
tctttcataatcaaacagta

SEQ ID NO: 811288 - DNA, 20 bp, Artificial
  CRISPR gRNA sequence
tcataatcaaacagtacccg

SEQ ID NO: 811289 - DNA, 20 bp, Artificial
  CRISPR gRNA sequence
cataatcaaacagtacccga

SEQ ID NO: 811290 - DNA, 20 bp, Artificial
  CRISPR gRNA sequence
ataatcaaacagtacccgaa

SEQ ID NO: 811291 - DNA, 20 bp, Artificial
  CRISPR gRNA sequence
cgagtactcactttatctct

SEQ ID NO: 811292 - DNA, 20 bp, Artificial
  CRISPR gRNA sequence
gagtactcactttatctctc

SEQ ID NO: 811293 - DNA, 20 bp, Artificial
  CRISPR gRNA sequence
actttatctctcattttgta

SEQ ID NO: 811294 - DNA, 20 bp, Artificial
  CRISPR gRNA sequence
tatctctcattttgtattat

SEQ ID NO: 811295 - DNA, 20 bp, Artificial
  CRISPR gRNA sequence
atctctcattttgtattatt

SEQ ID NO: 811296 - DNA, 20 bp, Artificial
  CRISPR gRNA sequence
tctctcattttgtattattt

SEQ ID NO: 811297 - DNA, 20 bp, Artificial
  CRISPR gRNA sequence
tcattttgtattatttatct

SEQ ID NO: 811298 - DNA, 20 bp, Artificial
  CRISPR gRNA sequence
attttgtattatttatctac

SEQ ID NO: 811299 - DNA, 20 bp, Artificial
  CRISPR gRNA sequence
tgtattatttatctacactt

SEQ ID NO: 811300 - DNA, 20 bp, Artificial
  CRISPR gRNA sequence
gtattatttatctacactta

SEQ ID NO: 811301 - DNA, 20 bp, Artificial
  CRISPR gRNA sequence
tattatttatctacacttat

SEQ ID NO: 811302 - DNA, 20 bp, Artificial
  CRISPR gRNA sequence
tttatctacacttattttcc

SEQ ID NO: 811303 - DNA, 20 bp, Artificial
  CRISPR gRNA sequence
atctacacttattttccctt

SEQ ID NO: 811304 - DNA, 20 bp, Artificial
  CRISPR gRNA sequence
tctacacttattttcccttg

SEQ ID NO: 811305 - DNA, 20 bp, Artificial
  CRISPR gRNA sequence
cacttattttcccttggttc

SEQ ID NO: 811306 - DNA, 20 bp, Artificial
  CRISPR gRNA sequence
attttcccttggttcaatgt

SEQ ID NO: 811307 - DNA, 20 bp, Artificial
  CRISPR gRNA sequence
ttttcccttggttcaatgtc

SEQ ID NO: 811308 - DNA, 20 bp, Artificial
  CRISPR gRNA sequence
tcccttggttcaatgtcttt

SEQ ID NO: 811309 - DNA, 20 bp, Artificial
  CRISPR gRNA sequence
cccttggttcaatgtctttt

SEQ ID NO: 811310 - DNA, 20 bp, Artificial
  CRISPR gRNA sequence
ccttggttcaatgtcttttg

SEQ ID NO: 811311 - DNA, 20 bp, Artificial
  CRISPR gRNA sequence
ggttcaatgtcttttgtaat

SEQ ID NO: 811312 - DNA, 20 bp, Artificial
  CRISPR gRNA sequence
gttcaatgtcttttgtaatc

SEQ ID NO: 811313 - DNA, 20 bp, Artificial
  CRISPR gRNA sequence
aatgtcttttgtaatcattt

SEQ ID NO: 811314 - DNA, 20 bp, Artificial
  CRISPR gRNA sequence
ttgtaatcattttatatgat

SEQ ID NO: 811315 - DNA, 20 bp, Artificial
  CRISPR gRNA sequence
tgtaatcattttatatgatc

SEQ ID NO: 811316 - DNA, 20 bp, Artificial
  CRISPR gRNA sequence
gtaatcattttatatgatca

SEQ ID NO: 811317 - DNA, 20 bp, Artificial
  CRISPR gRNA sequence
taatcattttatatgatcat

SEQ ID NO: 811318 - DNA, 20 bp, Artificial
  CRISPR gRNA sequence
tatatgatcatactgtagat

SEQ ID NO: 811319 - DNA, 20 bp, Artificial
  CRISPR gRNA sequence
atatgatcatactgtagatt

SEQ ID NO: 811320 - DNA, 20 bp, Artificial
  CRISPR gRNA sequence
tatgatcatactgtagatta

SEQ ID NO: 811321 - DNA, 20 bp, Artificial
  CRISPR gRNA sequence
tagattatttctgtaagctc

SEQ ID NO: 811322 - DNA, 20 bp, Artificial
  CRISPR gRNA sequence
tttctgtaagctctcaagtc

SEQ ID NO: 811323 - DNA, 20 bp, Artificial
  CRISPR gRNA sequence
ctgtaagctctcaagtcttt

SEQ ID NO: 811324 - DNA, 20 bp, Artificial
  CRISPR gRNA sequence
tgtaagctctcaagtctttt

SEQ ID NO: 811325 - DNA, 20 bp, Artificial
  CRISPR gRNA sequence
taagctctcaagtcttttgg

SEQ ID NO: 811326 - DNA, 20 bp, Artificial
  CRISPR gRNA sequence
tcaagtcttttggggaatga

SEQ ID NO: 811327 - DNA, 20 bp, Artificial
  CRISPR gRNA sequence
aagtcttttggggaatgaag

SEQ ID NO: 811328 - DNA, 20 bp, Artificial
  CRISPR gRNA sequence
ttggggaatgaagtagaaca

SEQ ID NO: 811329 - DNA, 20 bp, Artificial
  CRISPR gRNA sequence
tggggaatgaagtagaacaa

SEQ ID NO: 811330 - DNA, 20 bp, Artificial
  CRISPR gRNA sequence
ggggaatgaagtagaacaag

SEQ ID NO: 811331 - DNA, 20 bp, Artificial
  CRISPR gRNA sequence
gggaatgaagtagaacaaga

SEQ ID NO: 811332 - DNA, 20 bp, Artificial
  CRISPR gRNA sequence
tgggtgagggtccagcccac

SEQ ID NO: 811333 - DNA, 20 bp, Artificial
  CRISPR gRNA sequence
ttgcaggtggcttggaccaa

SEQ ID NO: 811334 - DNA, 20 bp, Artificial
  CRISPR gRNA sequence
caggtggcttggaccaagaa

SEQ ID NO: 811335 - DNA, 20 bp, Artificial
  CRISPR gRNA sequence
ggaccaagaaactgatcttg

SEQ ID NO: 811336 - DNA, 20 bp, Artificial
  CRISPR gRNA sequence
gaccaagaaactgatcttgg

SEQ ID NO: 811337 - DNA, 20 bp, Artificial
  CRISPR gRNA sequence
atcttggtgtcctggttgag

SEQ ID NO: 811338 - DNA, 20 bp, Artificial
  CRISPR gRNA sequence
ggtgtcctggttgagaagtg

SEQ ID NO: 811339 - DNA, 20 bp, Artificial
  CRISPR gRNA sequence
gtgtcctggttgagaagtga

SEQ ID NO: 811340 - DNA, 20 bp, Artificial
  CRISPR gRNA sequence
gttgagaagtgatttcagaa

SEQ ID NO: 811341 - DNA, 20 bp, Artificial
  CRISPR gRNA sequence
agaagtgatttcagaagtag

SEQ ID NO: 811342 - DNA, 20 bp, Artificial
  CRISPR gRNA sequence
cagaagtagggatgccagga

SEQ ID NO: 811343 - DNA, 20 bp, Artificial
  CRISPR gRNA sequence
agaagtagggatgccaggaa

SEQ ID NO: 811344 - DNA, 20 bp, Artificial
  CRISPR gRNA sequence
ggagcttggctgaggctttg

SEQ ID NO: 811345 - DNA, 20 bp, Artificial
  CRISPR gRNA sequence
ggctgaggctttgacttggg

SEQ ID NO: 811346 - DNA, 20 bp, Artificial
  CRISPR gRNA sequence
gctgaggctttgacttggga

SEQ ID NO: 811347 - DNA, 20 bp, Artificial
  CRISPR gRNA sequence
aggctttgacttgggataca

SEQ ID NO: 811348 - DNA, 20 bp, Artificial
  CRISPR gRNA sequence
tgacttgggatacatgaggg

SEQ ID NO: 811349 - DNA, 20 bp, Artificial
  CRISPR gRNA sequence
gacttgggatacatgaggga

SEQ ID NO: 811350 - DNA, 20 bp, Artificial
  CRISPR gRNA sequence
acttgggatacatgagggag

SEQ ID NO: 811351 - DNA, 20 bp, Artificial
  CRISPR gRNA sequence
gggatacatgagggagcaga

SEQ ID NO: 811352 - DNA, 20 bp, Artificial
  CRISPR gRNA sequence
ggatacatgagggagcagat

SEQ ID NO: 811353 - DNA, 20 bp, Artificial
  CRISPR gRNA sequence
ttccactacaagaatcagca

SEQ ID NO: 811354 - DNA, 20 bp, Artificial
  CRISPR gRNA sequence
ccactacaagaatcagcaag

SEQ ID NO: 811355 - DNA, 20 bp, Artificial
  CRISPR gRNA sequence
cactacaagaatcagcaagg

SEQ ID NO: 811356 - DNA, 20 bp, Artificial
  CRISPR gRNA sequence
caagaatcagcaaggtttgg

SEQ ID NO: 811357 - DNA, 20 bp, Artificial
  CRISPR gRNA sequence
ggggaagggacaggagccca

SEQ ID NO: 811358 - DNA, 20 bp, Artificial
  CRISPR gRNA sequence
gggaagggacaggagcccac

SEQ ID NO: 811359 - DNA, 20 bp, Artificial
  CRISPR gRNA sequence
catttttgcagtatcagaaa

SEQ ID NO: 811360 - DNA, 20 bp, Artificial
  CRISPR gRNA sequence
ttgcagtatcagaaatgtct

SEQ ID NO: 811361 - DNA, 20 bp, Artificial
  CRISPR gRNA sequence
tgcagtatcagaaatgtctc

SEQ ID NO: 811362 - DNA, 20 bp, Artificial
  CRISPR gRNA sequence
gcagtatcagaaatgtctcc

SEQ ID NO: 811363 - DNA, 20 bp, Artificial
  CRISPR gRNA sequence
cagtatcagaaatgtctcca

SEQ ID NO: 811364 - DNA, 20 bp, Artificial
  CRISPR gRNA sequence
cacagcctctttcttatttg

SEQ ID NO: 811365 - DNA, 20 bp, Artificial
  CRISPR gRNA sequence
tttcttatttggaaggtggt

SEQ ID NO: 811366 - DNA, 20 bp, Artificial
  CRISPR gRNA sequence
tcttatttggaaggtggtgg

SEQ ID NO: 811367 - DNA, 20 bp, Artificial
  CRISPR gRNA sequence
cttatttggaaggtggtgga

SEQ ID NO: 811368 - DNA, 20 bp, Artificial
  CRISPR gRNA sequence
ttatttggaaggtggtggaa

SEQ ID NO: 811369 - DNA, 20 bp, Artificial
  CRISPR gRNA sequence
atttggaaggtggtggaaaa

SEQ ID NO: 811370 - DNA, 20 bp, Artificial
  CRISPR gRNA sequence
tttggaaggtggtggaaaag

SEQ ID NO: 811371 - DNA, 20 bp, Artificial
  CRISPR gRNA sequence
ggaaggtggtggaaaaggaa

SEQ ID NO: 811372 - DNA, 20 bp, Artificial
  CRISPR gRNA sequence
gaaggtggtggaaaaggaat

SEQ ID NO: 811373 - DNA, 20 bp, Artificial
  CRISPR gRNA sequence
cccacagtggggaagctgga

SEQ ID NO: 811374 - DNA, 20 bp, Artificial
  CRISPR gRNA sequence
ccacagtggggaagctggac

SEQ ID NO: 811375 - DNA, 20 bp, Artificial
  CRISPR gRNA sequence
gactgagggtgatattctta

SEQ ID NO: 811376 - DNA, 20 bp, Artificial
  CRISPR gRNA sequence
agggtgatattcttaggaaa

SEQ ID NO: 811377 - DNA, 20 bp, Artificial
  CRISPR gRNA sequence
ttaggaaaagatgagtaaat

SEQ ID NO: 811378 - DNA, 20 bp, Artificial
  CRISPR gRNA sequence
aggaaaagatgagtaaattt

SEQ ID NO: 811379 - DNA, 20 bp, Artificial
  CRISPR gRNA sequence
ggaaaagatgagtaaatttt

SEQ ID NO: 811380 - DNA, 20 bp, Artificial
  CRISPR gRNA sequence
tagaatttaagaggcggaag

SEQ ID NO: 811381 - DNA, 20 bp, Artificial
  CRISPR gRNA sequence
agaatttaagaggcggaagt

SEQ ID NO: 811382 - DNA, 20 bp, Artificial
  CRISPR gRNA sequence
gaatttaagaggcggaagta

SEQ ID NO: 811383 - DNA, 20 bp, Artificial
  CRISPR gRNA sequence
aagaggcggaagtactccaa

SEQ ID NO: 811384 - DNA, 20 bp, Artificial
  CRISPR gRNA sequence
agaggcggaagtactccaaa

SEQ ID NO: 811385 - DNA, 20 bp, Artificial
  CRISPR gRNA sequence
caaaaattcaagtcatctga

SEQ ID NO: 811386 - DNA, 20 bp, Artificial
  CRISPR gRNA sequence
aagtcatctgacttattgct

SEQ ID NO: 811387 - DNA, 20 bp, Artificial
  CRISPR gRNA sequence
acttattgctcaatgaaaaa

SEQ ID NO: 811388 - DNA, 20 bp, Artificial
  CRISPR gRNA sequence
attgctcaatgaaaaacacc

SEQ ID NO: 811389 - DNA, 20 bp, Artificial
  CRISPR gRNA sequence
ttgctcaatgaaaaacacct

SEQ ID NO: 811390 - DNA, 20 bp, Artificial
  CRISPR gRNA sequence
ctcaatgaaaaacaccttct

SEQ ID NO: 811391 - DNA, 20 bp, Artificial
  CRISPR gRNA sequence
aatgaaaaacaccttctaca

SEQ ID NO: 811392 - DNA, 20 bp, Artificial
  CRISPR gRNA sequence
ctacagcaattctcctagat

SEQ ID NO: 811393 - DNA, 20 bp, Artificial
  CRISPR gRNA sequence
tacagcaattctcctagata

SEQ ID NO: 811394 - DNA, 20 bp, Artificial
  CRISPR gRNA sequence
cagcaattctcctagataat

SEQ ID NO: 811395 - DNA, 20 bp, Artificial
  CRISPR gRNA sequence
tcctagataattgctttgat

SEQ ID NO: 811396 - DNA, 20 bp, Artificial
  CRISPR gRNA sequence
ctagataattgctttgatga

SEQ ID NO: 811397 - DNA, 20 bp, Artificial
  CRISPR gRNA sequence
gataattgctttgatgattg

SEQ ID NO: 811398 - DNA, 20 bp, Artificial
  CRISPR gRNA sequence
ctttgatgattgttccacat

SEQ ID NO: 811399 - DNA, 20 bp, Artificial
  CRISPR gRNA sequence
tgatgattgttccacatacg

SEQ ID NO: 811400 - DNA, 20 bp, Artificial
  CRISPR gRNA sequence
gatgattgttccacatacgc

SEQ ID NO: 811401 - DNA, 20 bp, Artificial
  CRISPR gRNA sequence
atgattgttccacatacgct

SEQ ID NO: 811402 - DNA, 20 bp, Artificial
  CRISPR gRNA sequence
ttccacatacgcttgaaaac

SEQ ID NO: 811403 - DNA, 20 bp, Artificial
  CRISPR gRNA sequence
cacatacgcttgaaaacaat

SEQ ID NO: 811404 - DNA, 20 bp, Artificial
  CRISPR gRNA sequence
gaaaacaatgtgtgttctgt

SEQ ID NO: 811405 - DNA, 20 bp, Artificial
  CRISPR gRNA sequence
aaaacaatgtgtgttctgta

SEQ ID NO: 811406 - DNA, 20 bp, Artificial
  CRISPR gRNA sequence
tgtagttgctgggtgtatgt

SEQ ID NO: 811407 - DNA, 20 bp, Artificial
  CRISPR gRNA sequence
tagttgctgggtgtatgttc

SEQ ID NO: 811408 - DNA, 20 bp, Artificial
  CRISPR gRNA sequence
ctgggtgtatgttctatata

SEQ ID NO: 811409 - DNA, 20 bp, Artificial
  CRISPR gRNA sequence
ggtgtatgttctatatatca

SEQ ID NO: 811410 - DNA, 20 bp, Artificial
  CRISPR gRNA sequence
tatatatcatatgtctatta

SEQ ID NO: 811411 - DNA, 20 bp, Artificial
  CRISPR gRNA sequence
tatatcatatgtctattagg

SEQ ID NO: 811412 - DNA, 20 bp, Artificial
  CRISPR gRNA sequence
ttaggtcaagatggctaatt

SEQ ID NO: 811413 - DNA, 20 bp, Artificial
  CRISPR gRNA sequence
ggtcaagatggctaattgtg

SEQ ID NO: 811414 - DNA, 20 bp, Artificial
  CRISPR gRNA sequence
attgtgttgttcagattttc

SEQ ID NO: 811415 - DNA, 20 bp, Artificial
  CRISPR gRNA sequence
tgttgttcagattttctatt

SEQ ID NO: 811416 - DNA, 20 bp, Artificial
  CRISPR gRNA sequence
ttcagattttctattttctt

SEQ ID NO: 811417 - DNA, 20 bp, Artificial
  CRISPR gRNA sequence
agattttctattttcttaat

SEQ ID NO: 811418 - DNA, 20 bp, Artificial
  CRISPR gRNA sequence
tctattttcttaattgtttg

SEQ ID NO: 811419 - DNA, 20 bp, Artificial
  CRISPR gRNA sequence
ctattttcttaattgtttgt

SEQ ID NO: 811420 - DNA, 20 bp, Artificial
  CRISPR gRNA sequence
tattttcttaattgtttgtt

SEQ ID NO: 811421 - DNA, 20 bp, Artificial
  CRISPR gRNA sequence
ttttcttaattgtttgttct

SEQ ID NO: 811422 - DNA, 20 bp, Artificial
  CRISPR gRNA sequence
tcttaattgtttgttctatc

SEQ ID NO: 811423 - DNA, 20 bp, Artificial
  CRISPR gRNA sequence
cttaattgtttgttctatca

SEQ ID NO: 811424 - DNA, 20 bp, Artificial
  CRISPR gRNA sequence
ttaattgtttgttctatcag

SEQ ID NO: 811425 - DNA, 20 bp, Artificial
  CRISPR gRNA sequence
aattgtttgttctatcagtt

SEQ ID NO: 811426 - DNA, 20 bp, Artificial
  CRISPR gRNA sequence
attgtttgttctatcagttg

SEQ ID NO: 811427 - DNA, 20 bp, Artificial
  CRISPR gRNA sequence
tttgttctatcagttgtaat

SEQ ID NO: 811428 - DNA, 20 bp, Artificial
  CRISPR gRNA sequence
gttctatcagttgtaataga

SEQ ID NO: 811429 - DNA, 20 bp, Artificial
  CRISPR gRNA sequence
ttctatcagttgtaatagag

SEQ ID NO: 811430 - DNA, 20 bp, Artificial
  CRISPR gRNA sequence
tatcagttgtaatagagatg

SEQ ID NO: 811431 - DNA, 20 bp, Artificial
  CRISPR gRNA sequence
tcagttgtaatagagatgag

SEQ ID NO: 811432 - DNA, 20 bp, Artificial
  CRISPR gRNA sequence
taatagagatgagttgaaat

SEQ ID NO: 811433 - DNA, 20 bp, Artificial
  CRISPR gRNA sequence
aaatctcaaatgtaattgtg

SEQ ID NO: 811434 - DNA, 20 bp, Artificial
  CRISPR gRNA sequence
aaatgtaattgtggatttga

SEQ ID NO: 811435 - DNA, 20 bp, Artificial
  CRISPR gRNA sequence
tggatttgactggttctcct

SEQ ID NO: 811436 - DNA, 20 bp, Artificial
  CRISPR gRNA sequence
gactggttctcctaagtctg

SEQ ID NO: 811437 - DNA, 20 bp, Artificial
  CRISPR gRNA sequence
actggttctcctaagtctgc

SEQ ID NO: 811438 - DNA, 20 bp, Artificial
  CRISPR gRNA sequence
gttctcctaagtctgccaat

SEQ ID NO: 811439 - DNA, 20 bp, Artificial
  CRISPR gRNA sequence
tcctaagtctgccaattgtt

SEQ ID NO: 811440 - DNA, 20 bp, Artificial
  CRISPR gRNA sequence
ctaagtctgccaattgttgt

SEQ ID NO: 811441 - DNA, 20 bp, Artificial
  CRISPR gRNA sequence
agtctgccaattgttgttta

SEQ ID NO: 811442 - DNA, 20 bp, Artificial
  CRISPR gRNA sequence
ccaattgttgtttaatattt

SEQ ID NO: 811443 - DNA, 20 bp, Artificial
  CRISPR gRNA sequence
ttgtttaatattttgaagct

SEQ ID NO: 811444 - DNA, 20 bp, Artificial
  CRISPR gRNA sequence
tttaatattttgaagctata

SEQ ID NO: 811445 - DNA, 20 bp, Artificial
  CRISPR gRNA sequence
aatattttgaagctatactg

SEQ ID NO: 811446 - DNA, 20 bp, Artificial
  CRISPR gRNA sequence
atattttgaagctatactgt

SEQ ID NO: 811447 - DNA, 20 bp, Artificial
  CRISPR gRNA sequence
tgaagctatactgttaaatg

SEQ ID NO: 811448 - DNA, 20 bp, Artificial
  CRISPR gRNA sequence
gaagctatactgttaaatgg

SEQ ID NO: 811449 - DNA, 20 bp, Artificial
  CRISPR gRNA sequence
aagctatactgttaaatgga

SEQ ID NO: 811450 - DNA, 20 bp, Artificial
  CRISPR gRNA sequence
tactgttaaatggacacaca

SEQ ID NO: 811451 - DNA, 20 bp, Artificial
  CRISPR gRNA sequence
ttaaatggacacacatttag

SEQ ID NO: 811452 - DNA, 20 bp, Artificial
  CRISPR gRNA sequence
aatggacacacatttaggat

SEQ ID NO: 811453 - DNA, 20 bp, Artificial
  CRISPR gRNA sequence
aggattgttatgtgttcctt

SEQ ID NO: 811454 - DNA, 20 bp, Artificial
  CRISPR gRNA sequence
ggattgttatgtgttccttt

SEQ ID NO: 811455 - DNA, 20 bp, Artificial
  CRISPR gRNA sequence
ttatgtgttcctttagaact

SEQ ID NO: 811456 - DNA, 20 bp, Artificial
  CRISPR gRNA sequence
tgtgttcctttagaactcac

SEQ ID NO: 811457 - DNA, 20 bp, Artificial
  CRISPR gRNA sequence
ctttagaactcactctttta

SEQ ID NO: 811458 - DNA, 20 bp, Artificial
  CRISPR gRNA sequence
tagaactcactcttttatca

SEQ ID NO: 811459 - DNA, 20 bp, Artificial
  CRISPR gRNA sequence
agaactcactcttttatcat

SEQ ID NO: 811460 - DNA, 20 bp, Artificial
  CRISPR gRNA sequence
gaactcactcttttatcatt

SEQ ID NO: 811461 - DNA, 20 bp, Artificial
  CRISPR gRNA sequence
actcttttatcattatgaag

SEQ ID NO: 811462 - DNA, 20 bp, Artificial
  CRISPR gRNA sequence
ttttatcattatgaagtgtc

SEQ ID NO: 811463 - DNA, 20 bp, Artificial
  CRISPR gRNA sequence
ttatcattatgaagtgtccc

SEQ ID NO: 811464 - DNA, 20 bp, Artificial
  CRISPR gRNA sequence
tatcattatgaagtgtccct

SEQ ID NO: 811465 - DNA, 20 bp, Artificial
  CRISPR gRNA sequence
atcattatgaagtgtccctt

SEQ ID NO: 811466 - DNA, 20 bp, Artificial
  CRISPR gRNA sequence
tcattatgaagtgtcccttg

SEQ ID NO: 811467 - DNA, 20 bp, Artificial
  CRISPR gRNA sequence
tgaagtgtcccttgttatct

SEQ ID NO: 811468 - DNA, 20 bp, Artificial
  CRISPR gRNA sequence
gttatctttagtaatatttt

SEQ ID NO: 811469 - DNA, 20 bp, Artificial
  CRISPR gRNA sequence
ttatctttagtaatattttt

SEQ ID NO: 811470 - DNA, 20 bp, Artificial
  CRISPR gRNA sequence
tctttagtaatatttttctt

SEQ ID NO: 811471 - DNA, 20 bp, Artificial
  CRISPR gRNA sequence
tagtaatatttttcttctga

SEQ ID NO: 811472 - DNA, 20 bp, Artificial
  CRISPR gRNA sequence
agtaatatttttcttctgat

SEQ ID NO: 811473 - DNA, 20 bp, Artificial
  CRISPR gRNA sequence
gtaatatttttcttctgata

SEQ ID NO: 811474 - DNA, 20 bp, Artificial
  CRISPR gRNA sequence
ttcttctgatattagtaaac

SEQ ID NO: 811475 - DNA, 20 bp, Artificial
  CRISPR gRNA sequence
tcttctgatattagtaaact

SEQ ID NO: 811476 - DNA, 20 bp, Artificial
  CRISPR gRNA sequence
cttctgatattagtaaactg

SEQ ID NO: 811477 - DNA, 20 bp, Artificial
  CRISPR gRNA sequence
ttctgatattagtaaactgc

SEQ ID NO: 811478 - DNA, 20 bp, Artificial
  CRISPR gRNA sequence
ctgatattagtaaactgcta

SEQ ID NO: 811479 - DNA, 20 bp, Artificial
  CRISPR gRNA sequence
tgatattagtaaactgctaa

SEQ ID NO: 811480 - DNA, 20 bp, Artificial
  CRISPR gRNA sequence
atattagtaaactgctaaat

SEQ ID NO: 811481 - DNA, 20 bp, Artificial
  CRISPR gRNA sequence
gtaaactgctaaataacttt

SEQ ID NO: 811482 - DNA, 20 bp, Artificial
  CRISPR gRNA sequence
ctaaataacttttgcctgaa

SEQ ID NO: 811483 - DNA, 20 bp, Artificial
  CRISPR gRNA sequence
aataacttttgcctgaaaac

SEQ ID NO: 811484 - DNA, 20 bp, Artificial
  CRISPR gRNA sequence
ttgcctgaaaacatctatga

SEQ ID NO: 811485 - DNA, 20 bp, Artificial
  CRISPR gRNA sequence
tgcctgaaaacatctatgaa

SEQ ID NO: 811486 - DNA, 20 bp, Artificial
  CRISPR gRNA sequence
gcctgaaaacatctatgaat

SEQ ID NO: 811487 - DNA, 20 bp, Artificial
  CRISPR gRNA sequence
cctgaaaacatctatgaatg

SEQ ID NO: 811488 - DNA, 20 bp, Artificial
  CRISPR gRNA sequence
aaaacatctatgaatggaaa

SEQ ID NO: 811489 - DNA, 20 bp, Artificial
  CRISPR gRNA sequence
tgaatggaaactcctacttc

SEQ ID NO: 811490 - DNA, 20 bp, Artificial
  CRISPR gRNA sequence
ctacttcctctagaagcagt

SEQ ID NO: 811491 - DNA, 20 bp, Artificial
  CRISPR gRNA sequence
cttcctctagaagcagtctt

SEQ ID NO: 811492 - DNA, 20 bp, Artificial
  CRISPR gRNA sequence
cctctagaagcagtctttgc

SEQ ID NO: 811493 - DNA, 20 bp, Artificial
  CRISPR gRNA sequence
ctctagaagcagtctttgcc

SEQ ID NO: 811494 - DNA, 20 bp, Artificial
  CRISPR gRNA sequence
tagaagcagtctttgccatg

SEQ ID NO: 811495 - DNA, 20 bp, Artificial
  CRISPR gRNA sequence
gaagcagtctttgccatgat

SEQ ID NO: 811496 - DNA, 20 bp, Artificial
  CRISPR gRNA sequence
tgccatgattatacaataag

SEQ ID NO: 811497 - DNA, 20 bp, Artificial
  CRISPR gRNA sequence
gccatgattatacaataagc

SEQ ID NO: 811498 - DNA, 20 bp, Artificial
  CRISPR gRNA sequence
ccatgattatacaataagca

SEQ ID NO: 811499 - DNA, 20 bp, Artificial
  CRISPR gRNA sequence
tacaataagcaagttaaact

SEQ ID NO: 811500 - DNA, 20 bp, Artificial
  CRISPR gRNA sequence
aacttccattggaaagattt

SEQ ID NO: 811501 - DNA, 20 bp, Artificial
  CRISPR gRNA sequence
ccattggaaagattttcttc

SEQ ID NO: 811502 - DNA, 20 bp, Artificial
  CRISPR gRNA sequence
cattggaaagattttcttca

SEQ ID NO: 811503 - DNA, 20 bp, Artificial
  CRISPR gRNA sequence
gaaagattttcttcatgcca

SEQ ID NO: 811504 - DNA, 20 bp, Artificial
  CRISPR gRNA sequence
tcttcatgccaagcaaaatt

SEQ ID NO: 811505 - DNA, 20 bp, Artificial
  CRISPR gRNA sequence
cttcatgccaagcaaaattg

SEQ ID NO: 811506 - DNA, 20 bp, Artificial
  CRISPR gRNA sequence
ttcatgccaagcaaaattgt

SEQ ID NO: 811507 - DNA, 20 bp, Artificial
  CRISPR gRNA sequence
catgccaagcaaaattgtgc

SEQ ID NO: 811508 - DNA, 20 bp, Artificial
  CRISPR gRNA sequence
atgccaagcaaaattgtgcc

SEQ ID NO: 811509 - DNA, 20 bp, Artificial
  CRISPR gRNA sequence
tgcctctttgtagcttctac

SEQ ID NO: 811510 - DNA, 20 bp, Artificial
  CRISPR gRNA sequence
tttgtagcttctacccattg

SEQ ID NO: 811511 - DNA, 20 bp, Artificial
  CRISPR gRNA sequence
tgtagcttctacccattggt

SEQ ID NO: 811512 - DNA, 20 bp, Artificial
  CRISPR gRNA sequence
gtagcttctacccattggta

SEQ ID NO: 811513 - DNA, 20 bp, Artificial
  CRISPR gRNA sequence
tagcttctacccattggtat

SEQ ID NO: 811514 - DNA, 20 bp, Artificial
  CRISPR gRNA sequence
ctacccattggtatttgtct

SEQ ID NO: 811515 - DNA, 20 bp, Artificial
  CRISPR gRNA sequence
tacccattggtatttgtcta

SEQ ID NO: 811516 - DNA, 20 bp, Artificial
  CRISPR gRNA sequence
cccattggtatttgtctagt

SEQ ID NO: 811517 - DNA, 20 bp, Artificial
  CRISPR gRNA sequence
gtatttgtctagtttagtaa

SEQ ID NO: 811518 - DNA, 20 bp, Artificial
  CRISPR gRNA sequence
gtctagtttagtaacacaac

SEQ ID NO: 811519 - DNA, 20 bp, Artificial
  CRISPR gRNA sequence
tctagtttagtaacacaaca

SEQ ID NO: 811520 - DNA, 20 bp, Artificial
  CRISPR gRNA sequence
gtttagtaacacaacatatg

SEQ ID NO: 811521 - DNA, 20 bp, Artificial
  CRISPR gRNA sequence
agtaacacaacatatggtaa

SEQ ID NO: 811522 - DNA, 20 bp, Artificial
  CRISPR gRNA sequence
gtaacacaacatatggtaag

SEQ ID NO: 811523 - DNA, 20 bp, Artificial
  CRISPR gRNA sequence
aaaacatgagttcagaatct

SEQ ID NO: 811524 - DNA, 20 bp, Artificial
  CRISPR gRNA sequence
agaatctgagcagtttgagt

SEQ ID NO: 811525 - DNA, 20 bp, Artificial
  CRISPR gRNA sequence
agcagtttgagtaggcttta

SEQ ID NO: 811526 - DNA, 20 bp, Artificial
  CRISPR gRNA sequence
gagtaggctttagccaaggg

SEQ ID NO: 811527 - DNA, 20 bp, Artificial
  CRISPR gRNA sequence
agtaggctttagccaagggc

SEQ ID NO: 811528 - DNA, 20 bp, Artificial
  CRISPR gRNA sequence
tagccaagggctagttatat

SEQ ID NO: 811529 - DNA, 20 bp, Artificial
  CRISPR gRNA sequence
agccaagggctagttatatg

SEQ ID NO: 811530 - DNA, 20 bp, Artificial
  CRISPR gRNA sequence
gccaagggctagttatatga

SEQ ID NO: 811531 - DNA, 20 bp, Artificial
  CRISPR gRNA sequence
gttatatgacctcttaaacc

SEQ ID NO: 811532 - DNA, 20 bp, Artificial
  CRISPR gRNA sequence
tatgacctcttaaaccctca

SEQ ID NO: 811533 - DNA, 20 bp, Artificial
  CRISPR gRNA sequence
ttaaaccctcagttttcttg

SEQ ID NO: 811534 - DNA, 20 bp, Artificial
  CRISPR gRNA sequence
aaaccctcagttttcttgtt

SEQ ID NO: 811535 - DNA, 20 bp, Artificial
  CRISPR gRNA sequence
aaccctcagttttcttgttt

SEQ ID NO: 811536 - DNA, 20 bp, Artificial
  CRISPR gRNA sequence
agttttcttgtttaggaaat

SEQ ID NO: 811537 - DNA, 20 bp, Artificial
  CRISPR gRNA sequence
tcttgtttaggaaatggata

SEQ ID NO: 811538 - DNA, 20 bp, Artificial
  CRISPR gRNA sequence
cttgtttaggaaatggatac

SEQ ID NO: 811539 - DNA, 20 bp, Artificial
  CRISPR gRNA sequence
ttgtttaggaaatggataca

SEQ ID NO: 811540 - DNA, 20 bp, Artificial
  CRISPR gRNA sequence
gtttaggaaatggatacagc

SEQ ID NO: 811541 - DNA, 20 bp, Artificial
  CRISPR gRNA sequence
tttaggaaatggatacagca

SEQ ID NO: 811542 - DNA, 20 bp, Artificial
  CRISPR gRNA sequence
aggaaatggatacagcaata

SEQ ID NO: 811543 - DNA, 20 bp, Artificial
  CRISPR gRNA sequence
ggaaatggatacagcaatac

SEQ ID NO: 811544 - DNA, 20 bp, Artificial
  CRISPR gRNA sequence
atccttaacaagggtgttaa

SEQ ID NO: 811545 - DNA, 20 bp, Artificial
  CRISPR gRNA sequence
tccttaacaagggtgttaaa

SEQ ID NO: 811546 - DNA, 20 bp, Artificial
  CRISPR gRNA sequence
aacaagggtgttaaataatt

SEQ ID NO: 811547 - DNA, 20 bp, Artificial
  CRISPR gRNA sequence
acaagggtgttaaataatta

SEQ ID NO: 811548 - DNA, 20 bp, Artificial
  CRISPR gRNA sequence
aataattagttagatgtcta

SEQ ID NO: 811549 - DNA, 20 bp, Artificial
  CRISPR gRNA sequence
gttagatgtctagaacgtag

SEQ ID NO: 811550 - DNA, 20 bp, Artificial
  CRISPR gRNA sequence
gatgtctagaacgtagtaaa

SEQ ID NO: 811551 - DNA, 20 bp, Artificial
  CRISPR gRNA sequence
gaacgtagtaaacactcaat

SEQ ID NO: 811552 - DNA, 20 bp, Artificial
  CRISPR gRNA sequence
aattagtgttagcaattatt

SEQ ID NO: 811553 - DNA, 20 bp, Artificial
  CRISPR gRNA sequence
gtgttagcaattattgcagg

SEQ ID NO: 811554 - DNA, 20 bp, Artificial
  CRISPR gRNA sequence
gcaattattgcaggtaaccc

SEQ ID NO: 811555 - DNA, 20 bp, Artificial
  CRISPR gRNA sequence
ttgcaggtaacccttctgat

SEQ ID NO: 811556 - DNA, 20 bp, Artificial
  CRISPR gRNA sequence
caggtaacccttctgatatt

SEQ ID NO: 811557 - DNA, 20 bp, Artificial
  CRISPR gRNA sequence
ctgatatttgaatataactg

SEQ ID NO: 811558 - DNA, 20 bp, Artificial
  CRISPR gRNA sequence
tgatatttgaatataactgg

SEQ ID NO: 811559 - DNA, 20 bp, Artificial
  CRISPR gRNA sequence
atatttgaatataactggga

SEQ ID NO: 811560 - DNA, 20 bp, Artificial
  CRISPR gRNA sequence
gaatataactgggaagactc

SEQ ID NO: 811561 - DNA, 20 bp, Artificial
  CRISPR gRNA sequence
aatataactgggaagactcc

SEQ ID NO: 811562 - DNA, 20 bp, Artificial
  CRISPR gRNA sequence
ggaagactccatctagtctt

SEQ ID NO: 811563 - DNA, 20 bp, Artificial
  CRISPR gRNA sequence
catctagtcttttcaaccct

SEQ ID NO: 811564 - DNA, 20 bp, Artificial
  CRISPR gRNA sequence
gtcttttcaaccctaagtaa

SEQ ID NO: 811565 - DNA, 20 bp, Artificial
  CRISPR gRNA sequence
ttcaaccctaagtaaaacat

SEQ ID NO: 811566 - DNA, 20 bp, Artificial
  CRISPR gRNA sequence
tcaaccctaagtaaaacatg

SEQ ID NO: 811567 - DNA, 20 bp, Artificial
  CRISPR gRNA sequence
caaccctaagtaaaacatgc

SEQ ID NO: 811568 - DNA, 20 bp, Artificial
  CRISPR gRNA sequence
aaccctaagtaaaacatgcc

SEQ ID NO: 811569 - DNA, 20 bp, Artificial
  CRISPR gRNA sequence
agtaaaacatgcctacctcc

SEQ ID NO: 811570 - DNA, 20 bp, Artificial
  CRISPR gRNA sequence
cctcctttaactatatctca

SEQ ID NO: 811571 - DNA, 20 bp, Artificial
  CRISPR gRNA sequence
ctttaactatatctcacaag

SEQ ID NO: 811572 - DNA, 20 bp, Artificial
  CRISPR gRNA sequence
taactatatctcacaagata

SEQ ID NO: 811573 - DNA, 20 bp, Artificial
  CRISPR gRNA sequence
aactatatctcacaagatac

SEQ ID NO: 811574 - DNA, 20 bp, Artificial
  CRISPR gRNA sequence
actatatctcacaagataca

SEQ ID NO: 811575 - DNA, 20 bp, Artificial
  CRISPR gRNA sequence
tatctcacaagatacagtct

SEQ ID NO: 811576 - DNA, 20 bp, Artificial
  CRISPR gRNA sequence
acaagatacagtcttcagac

SEQ ID NO: 811577 - DNA, 20 bp, Artificial
  CRISPR gRNA sequence
cagacccatttccagatagt

SEQ ID NO: 811578 - DNA, 20 bp, Artificial
  CRISPR gRNA sequence
agacccatttccagatagta

SEQ ID NO: 811579 - DNA, 20 bp, Artificial
  CRISPR gRNA sequence
ccagatagtagtctttggtt

SEQ ID NO: 811580 - DNA, 20 bp, Artificial
  CRISPR gRNA sequence
cagatagtagtctttggtta

SEQ ID NO: 811581 - DNA, 20 bp, Artificial
  CRISPR gRNA sequence
tggttatagtttagttttgc

SEQ ID NO: 811582 - DNA, 20 bp, Artificial
  CRISPR gRNA sequence
ggttatagtttagttttgcc

SEQ ID NO: 811583 - DNA, 20 bp, Artificial
  CRISPR gRNA sequence
gttatagtttagttttgcca

SEQ ID NO: 811584 - DNA, 20 bp, Artificial
  CRISPR gRNA sequence
tagtttagttttgccacgtt

SEQ ID NO: 811585 - DNA, 20 bp, Artificial
  CRISPR gRNA sequence
agttttgccacgttctttaa

SEQ ID NO: 811586 - DNA, 20 bp, Artificial
  CRISPR gRNA sequence
gttttgccacgttctttaaa

SEQ ID NO: 811587 - DNA, 20 bp, Artificial
  CRISPR gRNA sequence
tgccacgttctttaaaaagg

SEQ ID NO: 811588 - DNA, 20 bp, Artificial
  CRISPR gRNA sequence
gccacgttctttaaaaagga

SEQ ID NO: 811589 - DNA, 20 bp, Artificial
  CRISPR gRNA sequence
ccacgttctttaaaaaggat

SEQ ID NO: 811590 - DNA, 20 bp, Artificial
  CRISPR gRNA sequence
tttaaaaaggatatgtaaca

SEQ ID NO: 811591 - DNA, 20 bp, Artificial
  CRISPR gRNA sequence
taaaaaggatatgtaacaca

SEQ ID NO: 811592 - DNA, 20 bp, Artificial
  CRISPR gRNA sequence
aaaaaggatatgtaacacaa

SEQ ID NO: 811593 - DNA, 20 bp, Artificial
  CRISPR gRNA sequence
aaaaggatatgtaacacaat

SEQ ID NO: 811594 - DNA, 20 bp, Artificial
  CRISPR gRNA sequence
tattctagatattatctaag

SEQ ID NO: 811595 - DNA, 20 bp, Artificial
  CRISPR gRNA sequence
tagatattatctaagcagca

SEQ ID NO: 811596 - DNA, 20 bp, Artificial
  CRISPR gRNA sequence
gatattatctaagcagcaca

SEQ ID NO: 811597 - DNA, 20 bp, Artificial
  CRISPR gRNA sequence
tctaagcagcacaaatatcc

SEQ ID NO: 811598 - DNA, 20 bp, Artificial
  CRISPR gRNA sequence
agcagcacaaatatccaggg

SEQ ID NO: 811599 - DNA, 20 bp, Artificial
  CRISPR gRNA sequence
taatgtaacctaaggtcata

SEQ ID NO: 811600 - DNA, 20 bp, Artificial
  CRISPR gRNA sequence
aatgtaacctaaggtcataa

SEQ ID NO: 811601 - DNA, 20 bp, Artificial
  CRISPR gRNA sequence
atgtaacctaaggtcataag

SEQ ID NO: 811602 - DNA, 20 bp, Artificial
  CRISPR gRNA sequence
aggtcataagatcagttttg

SEQ ID NO: 811603 - DNA, 20 bp, Artificial
  CRISPR gRNA sequence
tgctaaatatatgatctgct

SEQ ID NO: 811604 - DNA, 20 bp, Artificial
  CRISPR gRNA sequence
gctaaatatatgatctgctg

SEQ ID NO: 811605 - DNA, 20 bp, Artificial
  CRISPR gRNA sequence
ctaaatatatgatctgctgc

SEQ ID NO: 811606 - DNA, 20 bp, Artificial
  CRISPR gRNA sequence
aatatatgatctgctgctca

SEQ ID NO: 811607 - DNA, 20 bp, Artificial
  CRISPR gRNA sequence
ctgctcagttaggttggcta

SEQ ID NO: 811608 - DNA, 20 bp, Artificial
  CRISPR gRNA sequence
ctcagttaggttggctatat

SEQ ID NO: 811609 - DNA, 20 bp, Artificial
  CRISPR gRNA sequence
agttaggttggctatatcct

SEQ ID NO: 811610 - DNA, 20 bp, Artificial
  CRISPR gRNA sequence
ggttggctatatccttacaa

SEQ ID NO: 811611 - DNA, 20 bp, Artificial
  CRISPR gRNA sequence
gctatatccttacaacctga

SEQ ID NO: 811612 - DNA, 20 bp, Artificial
  CRISPR gRNA sequence
tatccttacaacctgaataa

SEQ ID NO: 811613 - DNA, 20 bp, Artificial
  CRISPR gRNA sequence
acaacctgaataacagaccc

SEQ ID NO: 811614 - DNA, 20 bp, Artificial
  CRISPR gRNA sequence
caacctgaataacagacccc

SEQ ID NO: 811615 - DNA, 20 bp, Artificial
  CRISPR gRNA sequence
aataacagaccccttagcac

SEQ ID NO: 811616 - DNA, 20 bp, Artificial
  CRISPR gRNA sequence
agcacttggagattgtctcc

SEQ ID NO: 811617 - DNA, 20 bp, Artificial
  CRISPR gRNA sequence
gcacttggagattgtctcca

SEQ ID NO: 811618 - DNA, 20 bp, Artificial
  CRISPR gRNA sequence
ggagattgtctccaagttga

SEQ ID NO: 811619 - DNA, 20 bp, Artificial
  CRISPR gRNA sequence
gagattgtctccaagttgac

SEQ ID NO: 811620 - DNA, 20 bp, Artificial
  CRISPR gRNA sequence
tctccaagttgactgaggcc

SEQ ID NO: 811621 - DNA, 20 bp, Artificial
  CRISPR gRNA sequence
caagttgactgaggccatca

SEQ ID NO: 811622 - DNA, 20 bp, Artificial
  CRISPR gRNA sequence
actgaggccatcagccagcc

SEQ ID NO: 811623 - DNA, 20 bp, Artificial
  CRISPR gRNA sequence
aggccatcagccagccttcg

SEQ ID NO: 811624 - DNA, 20 bp, Artificial
  CRISPR gRNA sequence
cgttgtccctgactcaacaa

SEQ ID NO: 811625 - DNA, 20 bp, Artificial
  CRISPR gRNA sequence
gttgtccctgactcaacaac

SEQ ID NO: 811626 - DNA, 20 bp, Artificial
  CRISPR gRNA sequence
tccctgactcaacaactact

SEQ ID NO: 811627 - DNA, 20 bp, Artificial
  CRISPR gRNA sequence
actcaacaactactagcttt

SEQ ID NO: 811628 - DNA, 20 bp, Artificial
  CRISPR gRNA sequence
aacaactactagcttttcag

SEQ ID NO: 811629 - DNA, 20 bp, Artificial
  CRISPR gRNA sequence
ctagcttttcagtctgttat

SEQ ID NO: 811630 - DNA, 20 bp, Artificial
  CRISPR gRNA sequence
gcttttcagtctgttataga

SEQ ID NO: 811631 - DNA, 20 bp, Artificial
  CRISPR gRNA sequence
ttcagtctgttatagatcta

SEQ ID NO: 811632 - DNA, 20 bp, Artificial
  CRISPR gRNA sequence
tcagtctgttatagatctag

SEQ ID NO: 811633 - DNA, 20 bp, Artificial
  CRISPR gRNA sequence
cagtctgttatagatctagt

SEQ ID NO: 811634 - DNA, 20 bp, Artificial
  CRISPR gRNA sequence
agtctgttatagatctagtc

SEQ ID NO: 811635 - DNA, 20 bp, Artificial
  CRISPR gRNA sequence
ttatagatctagtcaactgt

SEQ ID NO: 811636 - DNA, 20 bp, Artificial
  CRISPR gRNA sequence
tagatctagtcaactgtatt

SEQ ID NO: 811637 - DNA, 20 bp, Artificial
  CRISPR gRNA sequence
gtcaactgtattattatccc

SEQ ID NO: 811638 - DNA, 20 bp, Artificial
  CRISPR gRNA sequence
tattattatcccacctttta

SEQ ID NO: 811639 - DNA, 20 bp, Artificial
  CRISPR gRNA sequence
ttatcccaccttttaccacc

SEQ ID NO: 811640 - DNA, 20 bp, Artificial
  CRISPR gRNA sequence
tcccaccttttaccacccaa

SEQ ID NO: 811641 - DNA, 20 bp, Artificial
  CRISPR gRNA sequence
ttaccacccaatacacaagg

SEQ ID NO: 811642 - DNA, 20 bp, Artificial
  CRISPR gRNA sequence
taccacccaatacacaaggt

SEQ ID NO: 811643 - DNA, 20 bp, Artificial
  CRISPR gRNA sequence
accacccaatacacaaggtg

SEQ ID NO: 811644 - DNA, 20 bp, Artificial
  CRISPR gRNA sequence
ccacccaatacacaaggtgt

SEQ ID NO: 811645 - DNA, 20 bp, Artificial
  CRISPR gRNA sequence
tgtgtgtcctgggtctgttt

SEQ ID NO: 811646 - DNA, 20 bp, Artificial
  CRISPR gRNA sequence
gtgtgtcctgggtctgtttg

SEQ ID NO: 811647 - DNA, 20 bp, Artificial
  CRISPR gRNA sequence
tgtgtcctgggtctgtttgc

SEQ ID NO: 811648 - DNA, 20 bp, Artificial
  CRISPR gRNA sequence
ggtctgtttgccttcagatc

SEQ ID NO: 811649 - DNA, 20 bp, Artificial
  CRISPR gRNA sequence
tttgccttcagatccatctc

SEQ ID NO: 811650 - DNA, 20 bp, Artificial
  CRISPR gRNA sequence
gccttcagatccatctctca

SEQ ID NO: 811651 - DNA, 20 bp, Artificial
  CRISPR gRNA sequence
ccttcagatccatctctcac

SEQ ID NO: 811652 - DNA, 20 bp, Artificial
  CRISPR gRNA sequence
cagatccatctctcactttt

SEQ ID NO: 811653 - DNA, 20 bp, Artificial
  CRISPR gRNA sequence
agatccatctctcacttttt

SEQ ID NO: 811654 - DNA, 20 bp, Artificial
  CRISPR gRNA sequence
tcactttttcttctctgctc

SEQ ID NO: 811655 - DNA, 20 bp, Artificial
  CRISPR gRNA sequence
actttttcttctctgctctg

SEQ ID NO: 811656 - DNA, 20 bp, Artificial
  CRISPR gRNA sequence
tttcttctctgctctgtgtt

SEQ ID NO: 811657 - DNA, 20 bp, Artificial
  CRISPR gRNA sequence
ttcttctctgctctgtgttg

SEQ ID NO: 811658 - DNA, 20 bp, Artificial
  CRISPR gRNA sequence
tcttctctgctctgtgttgc

SEQ ID NO: 811659 - DNA, 20 bp, Artificial
  CRISPR gRNA sequence
cttctctgctctgtgttgca

SEQ ID NO: 811660 - DNA, 20 bp, Artificial
  CRISPR gRNA sequence
ttctctgctctgtgttgcag

SEQ ID NO: 811661 - DNA, 20 bp, Artificial
  CRISPR gRNA sequence
ctctgctctgtgttgcagga

SEQ ID NO: 811662 - DNA, 20 bp, Artificial
  CRISPR gRNA sequence
tctgctctgtgttgcaggaa

SEQ ID NO: 811663 - DNA, 20 bp, Artificial
  CRISPR gRNA sequence
tgctctgtgttgcaggaagg

SEQ ID NO: 811664 - DNA, 20 bp, Artificial
  CRISPR gRNA sequence
ctctgtgttgcaggaaggca

SEQ ID NO: 811665 - DNA, 20 bp, Artificial
  CRISPR gRNA sequence
tgtgttgcaggaaggcagac

SEQ ID NO: 811666 - DNA, 20 bp, Artificial
  CRISPR gRNA sequence
tgttgcaggaaggcagactc

SEQ ID NO: 811667 - DNA, 20 bp, Artificial
  CRISPR gRNA sequence
caggaaggcagactcctgtg

SEQ ID NO: 811668 - DNA, 20 bp, Artificial
  CRISPR gRNA sequence
ctgtggcctgtatagcctag

SEQ ID NO: 811669 - DNA, 20 bp, Artificial
  CRISPR gRNA sequence
tggcctgtatagcctaggaa

SEQ ID NO: 811670 - DNA, 20 bp, Artificial
  CRISPR gRNA sequence
tatagcctaggaacgtgaca

SEQ ID NO: 811671 - DNA, 20 bp, Artificial
  CRISPR gRNA sequence
ggaacgtgacagccaatagg

SEQ ID NO: 811672 - DNA, 20 bp, Artificial
  CRISPR gRNA sequence
gagggtggactggagggaga

SEQ ID NO: 811673 - DNA, 20 bp, Artificial
  CRISPR gRNA sequence
gagggagaagggaaggtatt

SEQ ID NO: 811674 - DNA, 20 bp, Artificial
  CRISPR gRNA sequence
ctcccctatgctctatactt

SEQ ID NO: 811675 - DNA, 20 bp, Artificial
  CRISPR gRNA sequence
tcccctatgctctatacttt

SEQ ID NO: 811676 - DNA, 20 bp, Artificial
  CRISPR gRNA sequence
ccctatgctctatacttttg

SEQ ID NO: 811677 - DNA, 20 bp, Artificial
  CRISPR gRNA sequence
tgctctatacttttgtggcc

SEQ ID NO: 811678 - DNA, 20 bp, Artificial
  CRISPR gRNA sequence
tatacttttgtggcctctcc

SEQ ID NO: 811679 - DNA, 20 bp, Artificial
  CRISPR gRNA sequence
tacttttgtggcctctccag

SEQ ID NO: 811680 - DNA, 20 bp, Artificial
  CRISPR gRNA sequence
ttgtggcctctccagcagaa

SEQ ID NO: 811681 - DNA, 20 bp, Artificial
  CRISPR gRNA sequence
tgtggcctctccagcagaag

SEQ ID NO: 811682 - DNA, 20 bp, Artificial
  CRISPR gRNA sequence
gtggcctctccagcagaaga

SEQ ID NO: 811683 - DNA, 20 bp, Artificial
  CRISPR gRNA sequence
tggcctctccagcagaagat

SEQ ID NO: 811684 - DNA, 20 bp, Artificial
  CRISPR gRNA sequence
tccagcagaagatgtatctc

SEQ ID NO: 811685 - DNA, 20 bp, Artificial
  CRISPR gRNA sequence
cagcagaagatgtatctctt

SEQ ID NO: 811686 - DNA, 20 bp, Artificial
  CRISPR gRNA sequence
ttccctggctccagatacca

SEQ ID NO: 811687 - DNA, 20 bp, Artificial
  CRISPR gRNA sequence
ccctggctccagataccaat

SEQ ID NO: 811688 - DNA, 20 bp, Artificial
  CRISPR gRNA sequence
cctggctccagataccaatg

SEQ ID NO: 811689 - DNA, 20 bp, Artificial
  CRISPR gRNA sequence
gctccagataccaatggaca

SEQ ID NO: 811690 - DNA, 20 bp, Artificial
  CRISPR gRNA sequence
cagataccaatggacaggcc

SEQ ID NO: 811691 - DNA, 20 bp, Artificial
  CRISPR gRNA sequence
ggttccagtgtctgtcaagt

SEQ ID NO: 811692 - DNA, 20 bp, Artificial
  CRISPR gRNA sequence
cagtgtctgtcaagtgactt

SEQ ID NO: 811693 - DNA, 20 bp, Artificial
  CRISPR gRNA sequence
tcaagtgactttaatccctg

SEQ ID NO: 811694 - DNA, 20 bp, Artificial
  CRISPR gRNA sequence
taatccctgggctccattaa

SEQ ID NO: 811695 - DNA, 20 bp, Artificial
  CRISPR gRNA sequence
aatccctgggctccattaac

SEQ ID NO: 811696 - DNA, 20 bp, Artificial
  CRISPR gRNA sequence
atccctgggctccattaacc

SEQ ID NO: 811697 - DNA, 20 bp, Artificial
  CRISPR gRNA sequence
ggctccattaaccctgcctt

SEQ ID NO: 811698 - DNA, 20 bp, Artificial
  CRISPR gRNA sequence
cattaaccctgccttccccc

SEQ ID NO: 811699 - DNA, 20 bp, Artificial
  CRISPR gRNA sequence
accctgccttcccccttttc

SEQ ID NO: 811700 - DNA, 20 bp, Artificial
  CRISPR gRNA sequence
ccttcccccttttcactata

SEQ ID NO: 811701 - DNA, 20 bp, Artificial
  CRISPR gRNA sequence
cccccttttcactatagcct

SEQ ID NO: 811702 - DNA, 20 bp, Artificial
  CRISPR gRNA sequence
ccccttttcactatagccta

SEQ ID NO: 811703 - DNA, 20 bp, Artificial
  CRISPR gRNA sequence
ttcactatagcctagtggta

SEQ ID NO: 811704 - DNA, 20 bp, Artificial
  CRISPR gRNA sequence
tcactatagcctagtggtag

SEQ ID NO: 811705 - DNA, 20 bp, Artificial
  CRISPR gRNA sequence
cactatagcctagtggtagg

SEQ ID NO: 811706 - DNA, 20 bp, Artificial
  CRISPR gRNA sequence
actatagcctagtggtagga

SEQ ID NO: 811707 - DNA, 20 bp, Artificial
  CRISPR gRNA sequence
tagcctagtggtaggagcag

SEQ ID NO: 811708 - DNA, 20 bp, Artificial
  CRISPR gRNA sequence
gtggtaggagcagctttctg

SEQ ID NO: 811709 - DNA, 20 bp, Artificial
  CRISPR gRNA sequence
tctgctattgctaatttctg

SEQ ID NO: 811710 - DNA, 20 bp, Artificial
  CRISPR gRNA sequence
ctgctattgctaatttctga

SEQ ID NO: 811711 - DNA, 20 bp, Artificial
  CRISPR gRNA sequence
tgctattgctaatttctgaa

SEQ ID NO: 811712 - DNA, 20 bp, Artificial
  CRISPR gRNA sequence
ctattgctaatttctgaatt

SEQ ID NO: 811713 - DNA, 20 bp, Artificial
  CRISPR gRNA sequence
ttgctaatttctgaattgct

SEQ ID NO: 811714 - DNA, 20 bp, Artificial
  CRISPR gRNA sequence
ctaatttctgaattgcttcc

SEQ ID NO: 811715 - DNA, 20 bp, Artificial
  CRISPR gRNA sequence
atttctgaattgcttccctg

SEQ ID NO: 811716 - DNA, 20 bp, Artificial
  CRISPR gRNA sequence
ctgaattgcttccctgttct

SEQ ID NO: 811717 - DNA, 20 bp, Artificial
  CRISPR gRNA sequence
tgaattgcttccctgttctc

SEQ ID NO: 811718 - DNA, 20 bp, Artificial
  CRISPR gRNA sequence
aattgcttccctgttctctg

SEQ ID NO: 811719 - DNA, 20 bp, Artificial
  CRISPR gRNA sequence
cttccctgttctctgtttgg

SEQ ID NO: 811720 - DNA, 20 bp, Artificial
  CRISPR gRNA sequence
ccctgttctctgtttggctt

SEQ ID NO: 811721 - DNA, 20 bp, Artificial
  CRISPR gRNA sequence
cctgttctctgtttggcttc

SEQ ID NO: 811722 - DNA, 20 bp, Artificial
  CRISPR gRNA sequence
ttctctgtttggcttctcag

SEQ ID NO: 811723 - DNA, 20 bp, Artificial
  CRISPR gRNA sequence
tctgtttggcttctcagtct

SEQ ID NO: 811724 - DNA, 20 bp, Artificial
  CRISPR gRNA sequence
tgtttggcttctcagtctcc

SEQ ID NO: 811725 - DNA, 20 bp, Artificial
  CRISPR gRNA sequence
tttggcttctcagtctccct

SEQ ID NO: 811726 - DNA, 20 bp, Artificial
  CRISPR gRNA sequence
ggcttctcagtctccctcat

SEQ ID NO: 811727 - DNA, 20 bp, Artificial
  CRISPR gRNA sequence
gcttctcagtctccctcatt

SEQ ID NO: 811728 - DNA, 20 bp, Artificial
  CRISPR gRNA sequence
ctcagtctccctcattaaaa

SEQ ID NO: 811729 - DNA, 20 bp, Artificial
  CRISPR gRNA sequence
tcagtctccctcattaaaag

SEQ ID NO: 811730 - DNA, 20 bp, Artificial
  CRISPR gRNA sequence
agtctccctcattaaaagaa

SEQ ID NO: 811731 - DNA, 20 bp, Artificial
  CRISPR gRNA sequence
cctcattaaaagaattacta

SEQ ID NO: 811732 - DNA, 20 bp, Artificial
  CRISPR gRNA sequence
attaaaagaattactagttt

SEQ ID NO: 811733 - DNA, 20 bp, Artificial
  CRISPR gRNA sequence
aaagaattactagtttcagc

SEQ ID NO: 811734 - DNA, 20 bp, Artificial
  CRISPR gRNA sequence
ctagtttcagctttagattt

SEQ ID NO: 811735 - DNA, 20 bp, Artificial
  CRISPR gRNA sequence
gtttcagctttagatttcca

SEQ ID NO: 811736 - DNA, 20 bp, Artificial
  CRISPR gRNA sequence
cagctttagatttccacagg

SEQ ID NO: 811737 - DNA, 20 bp, Artificial
  CRISPR gRNA sequence
agctttagatttccacaggt

SEQ ID NO: 811738 - DNA, 20 bp, Artificial
  CRISPR gRNA sequence
tagatttccacaggtttaaa

SEQ ID NO: 811739 - DNA, 20 bp, Artificial
  CRISPR gRNA sequence
agatttccacaggtttaaat

SEQ ID NO: 811740 - DNA, 20 bp, Artificial
  CRISPR gRNA sequence
gatttccacaggtttaaatg

SEQ ID NO: 811741 - DNA, 20 bp, Artificial
  CRISPR gRNA sequence
ccacaggtttaaatggtttc

SEQ ID NO: 811742 - DNA, 20 bp, Artificial
  CRISPR gRNA sequence
cacaggtttaaatggtttct

SEQ ID NO: 811743 - DNA, 20 bp, Artificial
  CRISPR gRNA sequence
aaatggtttctgtttccctg

SEQ ID NO: 811744 - DNA, 20 bp, Artificial
  CRISPR gRNA sequence
aatggtttctgtttccctgg

SEQ ID NO: 811745 - DNA, 20 bp, Artificial
  CRISPR gRNA sequence
ctgtttccctggtttgttct

SEQ ID NO: 811746 - DNA, 20 bp, Artificial
  CRISPR gRNA sequence
tgtttccctggtttgttctg

SEQ ID NO: 811747 - DNA, 20 bp, Artificial
  CRISPR gRNA sequence
tttccctggtttgttctggc

SEQ ID NO: 811748 - DNA, 20 bp, Artificial
  CRISPR gRNA sequence
ccctggtttgttctggctgt

SEQ ID NO: 811749 - DNA, 20 bp, Artificial
  CRISPR gRNA sequence
cctggtttgttctggctgtc

SEQ ID NO: 811750 - DNA, 20 bp, Artificial
  CRISPR gRNA sequence
gtttgttctggctgtctgac

SEQ ID NO: 811751 - DNA, 20 bp, Artificial
  CRISPR gRNA sequence
gttctggctgtctgacagat

SEQ ID NO: 811752 - DNA, 20 bp, Artificial
  CRISPR gRNA sequence
ttctggctgtctgacagata

SEQ ID NO: 811753 - DNA, 20 bp, Artificial
  CRISPR gRNA sequence
tggctgtctgacagatatgt

SEQ ID NO: 811754 - DNA, 20 bp, Artificial
  CRISPR gRNA sequence
gctgtctgacagatatgtta

SEQ ID NO: 811755 - DNA, 20 bp, Artificial
  CRISPR gRNA sequence
tctgacagatatgttacaag

SEQ ID NO: 811756 - DNA, 20 bp, Artificial
  CRISPR gRNA sequence
acagatatgttacaagcaat

SEQ ID NO: 811757 - DNA, 20 bp, Artificial
  CRISPR gRNA sequence
caagcaatgctgtaatttct

SEQ ID NO: 811758 - DNA, 20 bp, Artificial
  CRISPR gRNA sequence
taatttctgaaataaagatg

SEQ ID NO: 811759 - DNA, 20 bp, Artificial
  CRISPR gRNA sequence
ctgaaataaagatgaaatgt

SEQ ID NO: 811760 - DNA, 20 bp, Artificial
  CRISPR gRNA sequence
tgaaataaagatgaaatgta

SEQ ID NO: 811761 - DNA, 20 bp, Artificial
  CRISPR gRNA sequence
aaataaagatgaaatgtata

SEQ ID NO: 811762 - DNA, 20 bp, Artificial
  CRISPR gRNA sequence
ttttatagtcataatgacag

SEQ ID NO: 811763 - DNA, 20 bp, Artificial
  CRISPR gRNA sequence
tatagtcataatgacagtaa

SEQ ID NO: 811764 - DNA, 20 bp, Artificial
  CRISPR gRNA sequence
atagtcataatgacagtaaa

SEQ ID NO: 811765 - DNA, 20 bp, Artificial
  CRISPR gRNA sequence
tagtcataatgacagtaaat

SEQ ID NO: 811766 - DNA, 20 bp, Artificial
  CRISPR gRNA sequence
tacatgccttggtcttagag

SEQ ID NO: 811767 - DNA, 20 bp, Artificial
  CRISPR gRNA sequence
acatgccttggtcttagagg

SEQ ID NO: 811768 - DNA, 20 bp, Artificial
  CRISPR gRNA sequence
catgccttggtcttagagga

SEQ ID NO: 811769 - DNA, 20 bp, Artificial
  CRISPR gRNA sequence
ggtcttagaggatctatgca

SEQ ID NO: 811770 - DNA, 20 bp, Artificial
  CRISPR gRNA sequence
gtcttagaggatctatgcaa

SEQ ID NO: 811771 - DNA, 20 bp, Artificial
  CRISPR gRNA sequence
agaggatctatgcaagtttc

SEQ ID NO: 811772 - DNA, 20 bp, Artificial
  CRISPR gRNA sequence
gaggatctatgcaagtttct

SEQ ID NO: 811773 - DNA, 20 bp, Artificial
  CRISPR gRNA sequence
tgcaagtttctagtaatcag

SEQ ID NO: 811774 - DNA, 20 bp, Artificial
  CRISPR gRNA sequence
ctagtaatcagttaaatctt

SEQ ID NO: 811775 - DNA, 20 bp, Artificial
  CRISPR gRNA sequence
tagtaatcagttaaatcttt

SEQ ID NO: 811776 - DNA, 20 bp, Artificial
  CRISPR gRNA sequence
gtaatcagttaaatctttta

SEQ ID NO: 811777 - DNA, 20 bp, Artificial
  CRISPR gRNA sequence
aatcttttaggactgctttc

SEQ ID NO: 811778 - DNA, 20 bp, Artificial
  CRISPR gRNA sequence
ttaggactgctttcaattca

SEQ ID NO: 811779 - DNA, 20 bp, Artificial
  CRISPR gRNA sequence
taggactgctttcaattcat

SEQ ID NO: 811780 - DNA, 20 bp, Artificial
  CRISPR gRNA sequence
aggactgctttcaattcatc

SEQ ID NO: 811781 - DNA, 20 bp, Artificial
  CRISPR gRNA sequence
ggactgctttcaattcatct

SEQ ID NO: 811782 - DNA, 20 bp, Artificial
  CRISPR gRNA sequence
ctttcaattcatctgttaaa

SEQ ID NO: 811783 - DNA, 20 bp, Artificial
  CRISPR gRNA sequence
tcaattcatctgttaaattg

SEQ ID NO: 811784 - DNA, 20 bp, Artificial
  CRISPR gRNA sequence
caattcatctgttaaattgc

SEQ ID NO: 811785 - DNA, 20 bp, Artificial
  CRISPR gRNA sequence
aattcatctgttaaattgcc

SEQ ID NO: 811786 - DNA, 20 bp, Artificial
  CRISPR gRNA sequence
atctgttaaattgcctgaaa

SEQ ID NO: 811787 - DNA, 20 bp, Artificial
  CRISPR gRNA sequence
ttaaattgcctgaaaaggaa

SEQ ID NO: 811788 - DNA, 20 bp, Artificial
  CRISPR gRNA sequence
aattgcctgaaaaggaatag

SEQ ID NO: 811789 - DNA, 20 bp, Artificial
  CRISPR gRNA sequence
cctgaaaaggaatagcaggt

SEQ ID NO: 811790 - DNA, 20 bp, Artificial
  CRISPR gRNA sequence
aaaaggaatagcaggttaac

SEQ ID NO: 811791 - DNA, 20 bp, Artificial
  CRISPR gRNA sequence
acgagtttgtaatccccagg

SEQ ID NO: 811792 - DNA, 20 bp, Artificial
  CRISPR gRNA sequence
gtaatccccaggagcttccc

SEQ ID NO: 811793 - DNA, 20 bp, Artificial
  CRISPR gRNA sequence
taatccccaggagcttcccc

SEQ ID NO: 811794 - DNA, 20 bp, Artificial
  CRISPR gRNA sequence
cccctcccccccaccccatt

SEQ ID NO: 811795 - DNA, 20 bp, Artificial
  CRISPR gRNA sequence
ccctcccccccaccccattg

SEQ ID NO: 811796 - DNA, 20 bp, Artificial
  CRISPR gRNA sequence
ccccccaccccattgaaatt

SEQ ID NO: 811797 - DNA, 20 bp, Artificial
  CRISPR gRNA sequence
aaattcaggacattgttttc

SEQ ID NO: 811798 - DNA, 20 bp, Artificial
  CRISPR gRNA sequence
aggacattgttttctttttt

SEQ ID NO: 811799 - DNA, 20 bp, Artificial
  CRISPR gRNA sequence
ttttcttttttaaaataatt

SEQ ID NO: 811800 - DNA, 20 bp, Artificial
  CRISPR gRNA sequence
tcttttttaaaataatttct

SEQ ID NO: 811801 - DNA, 20 bp, Artificial
  CRISPR gRNA sequence
cttttttaaaataatttctt

SEQ ID NO: 811802 - DNA, 20 bp, Artificial
  CRISPR gRNA sequence
ttttttaaaataatttcttt

SEQ ID NO: 811803 - DNA, 20 bp, Artificial
  CRISPR gRNA sequence
ttttaaaataatttctttct

SEQ ID NO: 811804 - DNA, 20 bp, Artificial
  CRISPR gRNA sequence
tttaaaataatttctttctt

SEQ ID NO: 811805 - DNA, 20 bp, Artificial
  CRISPR gRNA sequence
ttaaaataatttctttcttt

SEQ ID NO: 811806 - DNA, 20 bp, Artificial
  CRISPR gRNA sequence
taaaataatttctttcttta

SEQ ID NO: 811807 - DNA, 20 bp, Artificial
  CRISPR gRNA sequence
aaaataatttctttctttat

SEQ ID NO: 811808 - DNA, 20 bp, Artificial
  CRISPR gRNA sequence
aaataatttctttctttatt

SEQ ID NO: 811809 - DNA, 20 bp, Artificial
  CRISPR gRNA sequence
ctttctttatttttaaaaaa

SEQ ID NO: 811810 - DNA, 20 bp, Artificial
  CRISPR gRNA sequence
tttctttatttttaaaaaac

SEQ ID NO: 811811 - DNA, 20 bp, Artificial
  CRISPR gRNA sequence
tctttatttttaaaaaacgt

SEQ ID NO: 811812 - DNA, 20 bp, Artificial
  CRISPR gRNA sequence
ctttatttttaaaaaacgtg

SEQ ID NO: 811813 - DNA, 20 bp, Artificial
  CRISPR gRNA sequence
tttatttttaaaaaacgtgt

SEQ ID NO: 811814 - DNA, 20 bp, Artificial
  CRISPR gRNA sequence
tatttttaaaaaacgtgtta

SEQ ID NO: 811815 - DNA, 20 bp, Artificial
  CRISPR gRNA sequence
atttttaaaaaacgtgttat

SEQ ID NO: 811816 - DNA, 20 bp, Artificial
  CRISPR gRNA sequence
tttttaaaaaacgtgttatt

SEQ ID NO: 811817 - DNA, 20 bp, Artificial
  CRISPR gRNA sequence
ttaaaaaacgtgttatttta

SEQ ID NO: 811818 - DNA, 20 bp, Artificial
  CRISPR gRNA sequence
taaaaaacgtgttattttac

SEQ ID NO: 811819 - DNA, 20 bp, Artificial
  CRISPR gRNA sequence
aaaaaacgtgttattttact

SEQ ID NO: 811820 - DNA, 20 bp, Artificial
  CRISPR gRNA sequence
aaaaacgtgttattttactc

SEQ ID NO: 811821 - DNA, 20 bp, Artificial
  CRISPR gRNA sequence
ttttactcctaggcttcccg

SEQ ID NO: 811822 - DNA, 20 bp, Artificial
  CRISPR gRNA sequence
tactcctaggcttcccgcta

SEQ ID NO: 811823 - DNA, 20 bp, Artificial
  CRISPR gRNA sequence
actcctaggcttcccgctac

SEQ ID NO: 811824 - DNA, 20 bp, Artificial
  CRISPR gRNA sequence
ctcctaggcttcccgctact

SEQ ID NO: 811825 - DNA, 20 bp, Artificial
  CRISPR gRNA sequence
ctaggcttcccgctactgca

SEQ ID NO: 811826 - DNA, 20 bp, Artificial
  CRISPR gRNA sequence
ggcttcccgctactgcaggc

SEQ ID NO: 811827 - DNA, 20 bp, Artificial
  CRISPR gRNA sequence
cccgctactgcaggcggagc

SEQ ID NO: 811828 - DNA, 20 bp, Artificial
  CRISPR gRNA sequence
ccgctactgcaggcggagct

SEQ ID NO: 811829 - DNA, 20 bp, Artificial
  CRISPR gRNA sequence
ctgcaggcggagctcaggac

SEQ ID NO: 811830 - DNA, 20 bp, Artificial
  CRISPR gRNA sequence
caggcggagctcaggacatt

SEQ ID NO: 811831 - DNA, 20 bp, Artificial
  CRISPR gRNA sequence
aggacattttcttgactccg

SEQ ID NO: 811832 - DNA, 20 bp, Artificial
  CRISPR gRNA sequence
tcttgactccgattttctta

SEQ ID NO: 811833 - DNA, 20 bp, Artificial
  CRISPR gRNA sequence
cttgactccgattttcttac

SEQ ID NO: 811834 - DNA, 20 bp, Artificial
  CRISPR gRNA sequence
ttgactccgattttcttaca

SEQ ID NO: 811835 - DNA, 20 bp, Artificial
  CRISPR gRNA sequence
gactccgattttcttacacc

SEQ ID NO: 811836 - DNA, 20 bp, Artificial
  CRISPR gRNA sequence
actccgattttcttacaccc

SEQ ID NO: 811837 - DNA, 20 bp, Artificial
  CRISPR gRNA sequence
cgattttcttacacccttct

SEQ ID NO: 811838 - DNA, 20 bp, Artificial
  CRISPR gRNA sequence
tcttacacccttctgtttcc

SEQ ID NO: 811839 - DNA, 20 bp, Artificial
  CRISPR gRNA sequence
cttacacccttctgtttccc

SEQ ID NO: 811840 - DNA, 20 bp, Artificial
  CRISPR gRNA sequence
ttacacccttctgtttcccc

SEQ ID NO: 811841 - DNA, 20 bp, Artificial
  CRISPR gRNA sequence
acacccttctgtttccccaa

SEQ ID NO: 811842 - DNA, 20 bp, Artificial
  CRISPR gRNA sequence
cacccttctgtttccccaag

SEQ ID NO: 811843 - DNA, 20 bp, Artificial
  CRISPR gRNA sequence
ctgtttccccaagggaaaaa

SEQ ID NO: 811844 - DNA, 20 bp, Artificial
  CRISPR gRNA sequence
tgtttccccaagggaaaaaa

SEQ ID NO: 811845 - DNA, 20 bp, Artificial
  CRISPR gRNA sequence
tttccccaagggaaaaaaag

SEQ ID NO: 811846 - DNA, 20 bp, Artificial
  CRISPR gRNA sequence
ccccaagggaaaaaaagaca

SEQ ID NO: 811847 - DNA, 20 bp, Artificial
  CRISPR gRNA sequence
cccaagggaaaaaaagacac

SEQ ID NO: 811848 - DNA, 20 bp, Artificial
  CRISPR gRNA sequence
agacttggctcttttagcaa

SEQ ID NO: 811849 - DNA, 20 bp, Artificial
  CRISPR gRNA sequence
ggctcttttagcaaatgctt

SEQ ID NO: 811850 - DNA, 20 bp, Artificial
  CRISPR gRNA sequence
gctcttttagcaaatgcttt

SEQ ID NO: 811851 - DNA, 20 bp, Artificial
  CRISPR gRNA sequence
ttttagcaaatgctttcctt

SEQ ID NO: 811852 - DNA, 20 bp, Artificial
  CRISPR gRNA sequence
ttagcaaatgctttccttgg

SEQ ID NO: 811853 - DNA, 20 bp, Artificial
  CRISPR gRNA sequence
tagcaaatgctttccttggg

SEQ ID NO: 811854 - DNA, 20 bp, Artificial
  CRISPR gRNA sequence
agcaaatgctttccttgggc

SEQ ID NO: 811855 - DNA, 20 bp, Artificial
  CRISPR gRNA sequence
gcaaatgctttccttgggcc

SEQ ID NO: 811856 - DNA, 20 bp, Artificial
  CRISPR gRNA sequence
tccttgggccttagaggctt

SEQ ID NO: 811857 - DNA, 20 bp, Artificial
  CRISPR gRNA sequence
ccttgggccttagaggctta

SEQ ID NO: 811858 - DNA, 20 bp, Artificial
  CRISPR gRNA sequence
cttgggccttagaggcttaa

SEQ ID NO: 811859 - DNA, 20 bp, Artificial
  CRISPR gRNA sequence
gggccttagaggcttaaacg

SEQ ID NO: 811860 - DNA, 20 bp, Artificial
  CRISPR gRNA sequence
ggccttagaggcttaaacgt

SEQ ID NO: 811861 - DNA, 20 bp, Artificial
  CRISPR gRNA sequence
agaggcttaaacgtacagtt

SEQ ID NO: 811862 - DNA, 20 bp, Artificial
  CRISPR gRNA sequence
gaggcttaaacgtacagttg

SEQ ID NO: 811863 - DNA, 20 bp, Artificial
  CRISPR gRNA sequence
aaacgtacagttgtcttttc

SEQ ID NO: 811864 - DNA, 20 bp, Artificial
  CRISPR gRNA sequence
aacgtacagttgtcttttca

SEQ ID NO: 811865 - DNA, 20 bp, Artificial
  CRISPR gRNA sequence
tcttttcactgctgccttgc

SEQ ID NO: 811866 - DNA, 20 bp, Artificial
  CRISPR gRNA sequence
ttcactgctgccttgcttct

SEQ ID NO: 811867 - DNA, 20 bp, Artificial
  CRISPR gRNA sequence
tcactgctgccttgcttctc

SEQ ID NO: 811868 - DNA, 20 bp, Artificial
  CRISPR gRNA sequence
cactgctgccttgcttctct

SEQ ID NO: 811869 - DNA, 20 bp, Artificial
  CRISPR gRNA sequence
actgctgccttgcttctctt

SEQ ID NO: 811870 - DNA, 20 bp, Artificial
  CRISPR gRNA sequence
ctgccttgcttctctttgat

SEQ ID NO: 811871 - DNA, 20 bp, Artificial
  CRISPR gRNA sequence
ccttgcttctctttgattgt

SEQ ID NO: 811872 - DNA, 20 bp, Artificial
  CRISPR gRNA sequence
gcttctctttgattgtttcc

SEQ ID NO: 811873 - DNA, 20 bp, Artificial
  CRISPR gRNA sequence
cttctctttgattgtttcct

SEQ ID NO: 811874 - DNA, 20 bp, Artificial
  CRISPR gRNA sequence
ctctttgattgtttccttcc

SEQ ID NO: 811875 - DNA, 20 bp, Artificial
  CRISPR gRNA sequence
tctttgattgtttccttcct

SEQ ID NO: 811876 - DNA, 20 bp, Artificial
  CRISPR gRNA sequence
tttgattgtttccttcctct

SEQ ID NO: 811877 - DNA, 20 bp, Artificial
  CRISPR gRNA sequence
tgattgtttccttcctctgc

SEQ ID NO: 811878 - DNA, 20 bp, Artificial
  CRISPR gRNA sequence
gattgtttccttcctctgcc

SEQ ID NO: 811879 - DNA, 20 bp, Artificial
  CRISPR gRNA sequence
attgtttccttcctctgccc

SEQ ID NO: 811880 - DNA, 20 bp, Artificial
  CRISPR gRNA sequence
tttccttcctctgcccttgg

SEQ ID NO: 811881 - DNA, 20 bp, Artificial
  CRISPR gRNA sequence
ccttcctctgcccttggttt

SEQ ID NO: 811882 - DNA, 20 bp, Artificial
  CRISPR gRNA sequence
cttcctctgcccttggtttc

SEQ ID NO: 811883 - DNA, 20 bp, Artificial
  CRISPR gRNA sequence
cctctgcccttggtttcttc

SEQ ID NO: 811884 - DNA, 20 bp, Artificial
  CRISPR gRNA sequence
ctctgcccttggtttcttcc

SEQ ID NO: 811885 - DNA, 20 bp, Artificial
  CRISPR gRNA sequence
tgcccttggtttcttccttc

SEQ ID NO: 811886 - DNA, 20 bp, Artificial
  CRISPR gRNA sequence
cccttggtttcttccttctt

SEQ ID NO: 811887 - DNA, 20 bp, Artificial
  CRISPR gRNA sequence
ggtttcttccttcttagggt

SEQ ID NO: 811888 - DNA, 20 bp, Artificial
  CRISPR gRNA sequence
gtttcttccttcttagggtg

SEQ ID NO: 811889 - DNA, 20 bp, Artificial
  CRISPR gRNA sequence
cttccttcttagggtgaagg

SEQ ID NO: 811890 - DNA, 20 bp, Artificial
  CRISPR gRNA sequence
ttccttcttagggtgaaggc

SEQ ID NO: 811891 - DNA, 20 bp, Artificial
  CRISPR gRNA sequence
ccttcttagggtgaaggcca

SEQ ID NO: 811892 - DNA, 20 bp, Artificial
  CRISPR gRNA sequence
cttcttagggtgaaggccat

SEQ ID NO: 811893 - DNA, 20 bp, Artificial
  CRISPR gRNA sequence
cttagggtgaaggccatttt

SEQ ID NO: 811894 - DNA, 20 bp, Artificial
  CRISPR gRNA sequence
ttagggtgaaggccattttt

SEQ ID NO: 811895 - DNA, 20 bp, Artificial
  CRISPR gRNA sequence
agggtgaaggccattttttt

SEQ ID NO: 811896 - DNA, 20 bp, Artificial
  CRISPR gRNA sequence
gggtgaaggccatttttttt

SEQ ID NO: 811897 - DNA, 20 bp, Artificial
  CRISPR gRNA sequence
tttttttttttttttttttg

SEQ ID NO: 811898 - DNA, 20 bp, Artificial
  CRISPR gRNA sequence
ttttttttttttttttttga

SEQ ID NO: 811899 - DNA, 20 bp, Artificial
  CRISPR gRNA sequence
tttttttttttttttttgag

SEQ ID NO: 811900 - DNA, 20 bp, Artificial
  CRISPR gRNA sequence
ttttttttttttttttgaga

SEQ ID NO: 811901 - DNA, 20 bp, Artificial
  CRISPR gRNA sequence
tttttttttttttttgagac

SEQ ID NO: 811902 - DNA, 20 bp, Artificial
  CRISPR gRNA sequence
ttttttttttttttgagacg

SEQ ID NO: 811903 - DNA, 20 bp, Artificial
  CRISPR gRNA sequence
tttttttttttttgagacgg

SEQ ID NO: 811904 - DNA, 20 bp, Artificial
  CRISPR gRNA sequence
ttttttttttttgagacgga

SEQ ID NO: 811905 - DNA, 20 bp, Artificial
  CRISPR gRNA sequence
tttttttttttgagacggag

SEQ ID NO: 811906 - DNA, 20 bp, Artificial
  CRISPR gRNA sequence
ttttttttttgagacggagt

SEQ ID NO: 811907 - DNA, 20 bp, Artificial
  CRISPR gRNA sequence
tttttttttgagacggagtc

SEQ ID NO: 811908 - DNA, 20 bp, Artificial
  CRISPR gRNA sequence
ttttttttgagacggagtct

SEQ ID NO: 811909 - DNA, 20 bp, Artificial
  CRISPR gRNA sequence
tttttttgagacggagtctc

SEQ ID NO: 811910 - DNA, 20 bp, Artificial
  CRISPR gRNA sequence
ttttttgagacggagtctcg

SEQ ID NO: 811911 - DNA, 20 bp, Artificial
  CRISPR gRNA sequence
tttttgagacggagtctcgc

SEQ ID NO: 811912 - DNA, 20 bp, Artificial
  CRISPR gRNA sequence
ttttgagacggagtctcgct

SEQ ID NO: 811913 - DNA, 20 bp, Artificial
  CRISPR gRNA sequence
tttgagacggagtctcgctc

SEQ ID NO: 811914 - DNA, 20 bp, Artificial
  CRISPR gRNA sequence
ttgagacggagtctcgctct

SEQ ID NO: 811915 - DNA, 20 bp, Artificial
  CRISPR gRNA sequence
tgagacggagtctcgctctg

SEQ ID NO: 811916 - DNA, 20 bp, Artificial
  CRISPR gRNA sequence
gagacggagtctcgctctgt

SEQ ID NO: 811917 - DNA, 20 bp, Artificial
  CRISPR gRNA sequence
agacggagtctcgctctgtc

SEQ ID NO: 811918 - DNA, 20 bp, Artificial
  CRISPR gRNA sequence
gctctgtcgcccaggctgga

SEQ ID NO: 811919 - DNA, 20 bp, Artificial
  CRISPR gRNA sequence
tgtcgcccaggctggagtgc

SEQ ID NO: 811920 - DNA, 20 bp, Artificial
  CRISPR gRNA sequence
tcgcccaggctggagtgcag

SEQ ID NO: 811921 - DNA, 20 bp, Artificial
  CRISPR gRNA sequence
gagtgcagtggtgcgacctc

SEQ ID NO: 811922 - DNA, 20 bp, Artificial
  CRISPR gRNA sequence
tgctcattgcaaaatccgcc

SEQ ID NO: 811923 - DNA, 20 bp, Artificial
  CRISPR gRNA sequence
ctcattgcaaaatccgcctc

SEQ ID NO: 811924 - DNA, 20 bp, Artificial
  CRISPR gRNA sequence
attgcaaaatccgcctccca

SEQ ID NO: 811925 - DNA, 20 bp, Artificial
  CRISPR gRNA sequence
caaaatccgcctcccaggtt

SEQ ID NO: 811926 - DNA, 20 bp, Artificial
  CRISPR gRNA sequence
ccaggttcctgccattctcc

SEQ ID NO: 811927 - DNA, 20 bp, Artificial
  CRISPR gRNA sequence
ctgccattctcctgcctcag

SEQ ID NO: 811928 - DNA, 20 bp, Artificial
  CRISPR gRNA sequence
ccattctcctgcctcagcct

SEQ ID NO: 811929 - DNA, 20 bp, Artificial
  CRISPR gRNA sequence
tcctgcctcagcctcccgag

SEQ ID NO: 811930 - DNA, 20 bp, Artificial
  CRISPR gRNA sequence
ctgcctcagcctcccgagta

SEQ ID NO: 811931 - DNA, 20 bp, Artificial
  CRISPR gRNA sequence
cctcagcctcccgagtagct

SEQ ID NO: 811932 - DNA, 20 bp, Artificial
  CRISPR gRNA sequence
agcctcccgagtagctgcga

SEQ ID NO: 811933 - DNA, 20 bp, Artificial
  CRISPR gRNA sequence
ccgagtagctgcgactgcag

SEQ ID NO: 811934 - DNA, 20 bp, Artificial
  CRISPR gRNA sequence
cgactgcaggtgcctgccac

SEQ ID NO: 811935 - DNA, 20 bp, Artificial
  CRISPR gRNA sequence
caggtgcctgccaccacgcc

SEQ ID NO: 811936 - DNA, 20 bp, Artificial
  CRISPR gRNA sequence
ccaccacgcccggctaattt

SEQ ID NO: 811937 - DNA, 20 bp, Artificial
  CRISPR gRNA sequence
attttttgtatttttagtag

SEQ ID NO: 811938 - DNA, 20 bp, Artificial
  CRISPR gRNA sequence
tttgtatttttagtagagac

SEQ ID NO: 811939 - DNA, 20 bp, Artificial
  CRISPR gRNA sequence
ttgtatttttagtagagacg

SEQ ID NO: 811940 - DNA, 20 bp, Artificial
  CRISPR gRNA sequence
tgtatttttagtagagacgg

SEQ ID NO: 811941 - DNA, 20 bp, Artificial
  CRISPR gRNA sequence
gtatttttagtagagacggg

SEQ ID NO: 811942 - DNA, 20 bp, Artificial
  CRISPR gRNA sequence
tatttttagtagagacgggg

SEQ ID NO: 811943 - DNA, 20 bp, Artificial
  CRISPR gRNA sequence
ttagtagagacggggtttca

SEQ ID NO: 811944 - DNA, 20 bp, Artificial
  CRISPR gRNA sequence
tagtagagacggggtttcac

SEQ ID NO: 811945 - DNA, 20 bp, Artificial
  CRISPR gRNA sequence
agtagagacggggtttcacc

SEQ ID NO: 811946 - DNA, 20 bp, Artificial
  CRISPR gRNA sequence
gtagagacggggtttcaccg

SEQ ID NO: 811947 - DNA, 20 bp, Artificial
  CRISPR gRNA sequence
caccgtgttagccaggatga

SEQ ID NO: 811948 - DNA, 20 bp, Artificial
  CRISPR gRNA sequence
accgtgttagccaggatgat

SEQ ID NO: 811949 - DNA, 20 bp, Artificial
  CRISPR gRNA sequence
gccaggatgatcttgatctc

SEQ ID NO: 811950 - DNA, 20 bp, Artificial
  CRISPR gRNA sequence
gatctcctgacctcgtgatc

SEQ ID NO: 811951 - DNA, 20 bp, Artificial
  CRISPR gRNA sequence
atctcctgacctcgtgatct

SEQ ID NO: 811952 - DNA, 20 bp, Artificial
  CRISPR gRNA sequence
ctgacctcgtgatctgccca

SEQ ID NO: 811953 - DNA, 20 bp, Artificial
  CRISPR gRNA sequence
acctcgtgatctgcccacct

SEQ ID NO: 811954 - DNA, 20 bp, Artificial
  CRISPR gRNA sequence
gtgatctgcccacctcggcc

SEQ ID NO: 811955 - DNA, 20 bp, Artificial
  CRISPR gRNA sequence
cccacctcggcctcccaaag

SEQ ID NO: 811956 - DNA, 20 bp, Artificial
  CRISPR gRNA sequence
ggcctcccaaagtgctggga

SEQ ID NO: 811957 - DNA, 20 bp, Artificial
  CRISPR gRNA sequence
ccaaagtgctgggattacag

SEQ ID NO: 811958 - DNA, 20 bp, Artificial
  CRISPR gRNA sequence
ggattacaggtgtgagcaac

SEQ ID NO: 811959 - DNA, 20 bp, Artificial
  CRISPR gRNA sequence
caggtgtgagcaaccacgcc

SEQ ID NO: 811960 - DNA, 20 bp, Artificial
  CRISPR gRNA sequence
gcccaaatgtggagtttttt

SEQ ID NO: 811961 - DNA, 20 bp, Artificial
  CRISPR gRNA sequence
tttatctctcacccccaacc

SEQ ID NO: 811962 - DNA, 20 bp, Artificial
  CRISPR gRNA sequence
ttatctctcacccccaacca

SEQ ID NO: 811963 - DNA, 20 bp, Artificial
  CRISPR gRNA sequence
tatctctcacccccaaccat

SEQ ID NO: 811964 - DNA, 20 bp, Artificial
  CRISPR gRNA sequence
atctctcacccccaaccatc

SEQ ID NO: 811965 - DNA, 20 bp, Artificial
  CRISPR gRNA sequence
tctctcacccccaaccatcc

SEQ ID NO: 811966 - DNA, 20 bp, Artificial
  CRISPR gRNA sequence
tcacccccaaccatcctttc

SEQ ID NO: 811967 - DNA, 20 bp, Artificial
  CRISPR gRNA sequence
acccccaaccatcctttccc

SEQ ID NO: 811968 - DNA, 20 bp, Artificial
  CRISPR gRNA sequence
tcccctaagtcctgaaagtc

SEQ ID NO: 811969 - DNA, 20 bp, Artificial
  CRISPR gRNA sequence
cccctaagtcctgaaagtcc

SEQ ID NO: 811970 - DNA, 20 bp, Artificial
  CRISPR gRNA sequence
ccctaagtcctgaaagtcca

SEQ ID NO: 811971 - DNA, 20 bp, Artificial
  CRISPR gRNA sequence
agtcctgaaagtccattgta

SEQ ID NO: 811972 - DNA, 20 bp, Artificial
  CRISPR gRNA sequence
aaagtccattgtatcattct

SEQ ID NO: 811973 - DNA, 20 bp, Artificial
  CRISPR gRNA sequence
tatcattcttatgcctttcc

SEQ ID NO: 811974 - DNA, 20 bp, Artificial
  CRISPR gRNA sequence
ttatgcctttccatcctcat

SEQ ID NO: 811975 - DNA, 20 bp, Artificial
  CRISPR gRNA sequence
atgcctttccatcctcatag

SEQ ID NO: 811976 - DNA, 20 bp, Artificial
  CRISPR gRNA sequence
tgcctttccatcctcatagc

SEQ ID NO: 811977 - DNA, 20 bp, Artificial
  CRISPR gRNA sequence
tccatcctcatagcttagct

SEQ ID NO: 811978 - DNA, 20 bp, Artificial
  CRISPR gRNA sequence
ccatcctcatagcttagctc

SEQ ID NO: 811979 - DNA, 20 bp, Artificial
  CRISPR gRNA sequence
catcctcatagcttagctcg

SEQ ID NO: 811980 - DNA, 20 bp, Artificial
  CRISPR gRNA sequence
atagcttagctcgcacttat

SEQ ID NO: 811981 - DNA, 20 bp, Artificial
  CRISPR gRNA sequence
agctcgcacttatgagtgag

SEQ ID NO: 811982 - DNA, 20 bp, Artificial
  CRISPR gRNA sequence
gctcgcacttatgagtgaga

SEQ ID NO: 811983 - DNA, 20 bp, Artificial
  CRISPR gRNA sequence
gcacttatgagtgagagcat

SEQ ID NO: 811984 - DNA, 20 bp, Artificial
  CRISPR gRNA sequence
atgagtgagagcatacaatg

SEQ ID NO: 811985 - DNA, 20 bp, Artificial
  CRISPR gRNA sequence
tgagtgagagcatacaatgt

SEQ ID NO: 811986 - DNA, 20 bp, Artificial
  CRISPR gRNA sequence
ggttttacattcctgagtta

SEQ ID NO: 811987 - DNA, 20 bp, Artificial
  CRISPR gRNA sequence
gttttacattcctgagttac

SEQ ID NO: 811988 - DNA, 20 bp, Artificial
  CRISPR gRNA sequence
tacattcctgagttacttca

SEQ ID NO: 811989 - DNA, 20 bp, Artificial
  CRISPR gRNA sequence
acattcctgagttacttcac

SEQ ID NO: 811990 - DNA, 20 bp, Artificial
  CRISPR gRNA sequence
cattcctgagttacttcact

SEQ ID NO: 811991 - DNA, 20 bp, Artificial
  CRISPR gRNA sequence
ctgagttacttcacttagaa

SEQ ID NO: 811992 - DNA, 20 bp, Artificial
  CRISPR gRNA sequence
agttacttcacttagaataa

SEQ ID NO: 811993 - DNA, 20 bp, Artificial
  CRISPR gRNA sequence
cttcacttagaataatagtc

SEQ ID NO: 811994 - DNA, 20 bp, Artificial
  CRISPR gRNA sequence
cacttagaataatagtctct

SEQ ID NO: 811995 - DNA, 20 bp, Artificial
  CRISPR gRNA sequence
acttagaataatagtctcta

SEQ ID NO: 811996 - DNA, 20 bp, Artificial
  CRISPR gRNA sequence
agaataatagtctctaattc

SEQ ID NO: 811997 - DNA, 20 bp, Artificial
  CRISPR gRNA sequence
gaataatagtctctaattcc

SEQ ID NO: 811998 - DNA, 20 bp, Artificial
  CRISPR gRNA sequence
taattccatccaggatgctg

SEQ ID NO: 811999 - DNA, 20 bp, Artificial
  CRISPR gRNA sequence
attccatccaggatgctgca

SEQ ID NO: 812000 - DNA, 20 bp, Artificial
  CRISPR gRNA sequence
catccaggatgctgcaaatg

SEQ ID NO: 812001 - DNA, 20 bp, Artificial
  CRISPR gRNA sequence
caaatgctatgatttcattc

SEQ ID NO: 812002 - DNA, 20 bp, Artificial
  CRISPR gRNA sequence
tgatttcattccttttcata

SEQ ID NO: 812003 - DNA, 20 bp, Artificial
  CRISPR gRNA sequence
cattccttttcatagctaag

SEQ ID NO: 812004 - DNA, 20 bp, Artificial
  CRISPR gRNA sequence
attccttttcatagctaagt

SEQ ID NO: 812005 - DNA, 20 bp, Artificial
  CRISPR gRNA sequence
cttttcatagctaagtagta

SEQ ID NO: 812006 - DNA, 20 bp, Artificial
  CRISPR gRNA sequence
ttcatagctaagtagtattc

SEQ ID NO: 812007 - DNA, 20 bp, Artificial
  CRISPR gRNA sequence
tcatagctaagtagtattcc

SEQ ID NO: 812008 - DNA, 20 bp, Artificial
  CRISPR gRNA sequence
catagctaagtagtattcca

SEQ ID NO: 812009 - DNA, 20 bp, Artificial
  CRISPR gRNA sequence
atagctaagtagtattccat

SEQ ID NO: 812010 - DNA, 20 bp, Artificial
  CRISPR gRNA sequence
agtagtattccatggtgtat

SEQ ID NO: 812011 - DNA, 20 bp, Artificial
  CRISPR gRNA sequence
catggtgtatatatataata

SEQ ID NO: 812012 - DNA, 20 bp, Artificial
  CRISPR gRNA sequence
tctttatccactcactgatt

SEQ ID NO: 812013 - DNA, 20 bp, Artificial
  CRISPR gRNA sequence
ctttatccactcactgattg

SEQ ID NO: 812014 - DNA, 20 bp, Artificial
  CRISPR gRNA sequence
tttatccactcactgattga

SEQ ID NO: 812015 - DNA, 20 bp, Artificial
  CRISPR gRNA sequence
tatccactcactgattgatg

SEQ ID NO: 812016 - DNA, 20 bp, Artificial
  CRISPR gRNA sequence
atccactcactgattgatgg

SEQ ID NO: 812017 - DNA, 20 bp, Artificial
  CRISPR gRNA sequence
tccactcactgattgatggg

SEQ ID NO: 812018 - DNA, 20 bp, Artificial
  CRISPR gRNA sequence
actgattgatgggcatttgg

SEQ ID NO: 812019 - DNA, 20 bp, Artificial
  CRISPR gRNA sequence
attgatgggcatttgggctg

SEQ ID NO: 812020 - DNA, 20 bp, Artificial
  CRISPR gRNA sequence
atgggcatttgggctggttc

SEQ ID NO: 812021 - DNA, 20 bp, Artificial
  CRISPR gRNA sequence
gggctggttccatatatttg

SEQ ID NO: 812022 - DNA, 20 bp, Artificial
  CRISPR gRNA sequence
ggctggttccatatatttgc

SEQ ID NO: 812023 - DNA, 20 bp, Artificial
  CRISPR gRNA sequence
gttccatatatttgcaattg

SEQ ID NO: 812024 - DNA, 20 bp, Artificial
  CRISPR gRNA sequence
catatatttgcaattgcaaa

SEQ ID NO: 812025 - DNA, 20 bp, Artificial
  CRISPR gRNA sequence
gcaattgcaaattgtgctgc

SEQ ID NO: 812026 - DNA, 20 bp, Artificial
  CRISPR gRNA sequence
caattgcaaattgtgctgct

SEQ ID NO: 812027 - DNA, 20 bp, Artificial
  CRISPR gRNA sequence
caaattgtgctgctataaaa

SEQ ID NO: 812028 - DNA, 20 bp, Artificial
  CRISPR gRNA sequence
tgctgctataaaaatgcgtg

SEQ ID NO: 812029 - DNA, 20 bp, Artificial
  CRISPR gRNA sequence
ctataaaaatgcgtgtgcaa

SEQ ID NO: 812030 - DNA, 20 bp, Artificial
  CRISPR gRNA sequence
taaaaatgcgtgtgcaagta

SEQ ID NO: 812031 - DNA, 20 bp, Artificial
  CRISPR gRNA sequence
ttttttgtataatgacttct

SEQ ID NO: 812032 - DNA, 20 bp, Artificial
  CRISPR gRNA sequence
tttttgtataatgacttctt

SEQ ID NO: 812033 - DNA, 20 bp, Artificial
  CRISPR gRNA sequence
ttttgtataatgacttcttt

SEQ ID NO: 812034 - DNA, 20 bp, Artificial
  CRISPR gRNA sequence
tttgtataatgacttctttt

SEQ ID NO: 812035 - DNA, 20 bp, Artificial
  CRISPR gRNA sequence
ttgtataatgacttcttttc

SEQ ID NO: 812036 - DNA, 20 bp, Artificial
  CRISPR gRNA sequence
tgtataatgacttcttttcc

SEQ ID NO: 812037 - DNA, 20 bp, Artificial
  CRISPR gRNA sequence
gtataatgacttcttttcct

SEQ ID NO: 812038 - DNA, 20 bp, Artificial
  CRISPR gRNA sequence
tataatgacttcttttcctt

SEQ ID NO: 812039 - DNA, 20 bp, Artificial
  CRISPR gRNA sequence
cttttcctttgggtaaatac

SEQ ID NO: 812040 - DNA, 20 bp, Artificial
  CRISPR gRNA sequence
ttttcctttgggtaaatacc

SEQ ID NO: 812041 - DNA, 20 bp, Artificial
  CRISPR gRNA sequence
ttcctttgggtaaataccta

SEQ ID NO: 812042 - DNA, 20 bp, Artificial
  CRISPR gRNA sequence
tcctttgggtaaatacctag

SEQ ID NO: 812043 - DNA, 20 bp, Artificial
  CRISPR gRNA sequence
cctttgggtaaatacctagt

SEQ ID NO: 812044 - DNA, 20 bp, Artificial
  CRISPR gRNA sequence
ctttgggtaaatacctagta

SEQ ID NO: 812045 - DNA, 20 bp, Artificial
  CRISPR gRNA sequence
tgggtaaatacctagtagtg

SEQ ID NO: 812046 - DNA, 20 bp, Artificial
  CRISPR gRNA sequence
gggtaaatacctagtagtgg

SEQ ID NO: 812047 - DNA, 20 bp, Artificial
  CRISPR gRNA sequence
ggtaaatacctagtagtggg

SEQ ID NO: 812048 - DNA, 20 bp, Artificial
  CRISPR gRNA sequence
gtagtgggattgctggatca

SEQ ID NO: 812049 - DNA, 20 bp, Artificial
  CRISPR gRNA sequence
ctggatcaaatggtagatct

SEQ ID NO: 812050 - DNA, 20 bp, Artificial
  CRISPR gRNA sequence
gatcaaatggtagatctact

SEQ ID NO: 812051 - DNA, 20 bp, Artificial
  CRISPR gRNA sequence
cttttagtttttaaaggaat

SEQ ID NO: 812052 - DNA, 20 bp, Artificial
  CRISPR gRNA sequence
ttagtttttaaaggaatctc

SEQ ID NO: 812053 - DNA, 20 bp, Artificial
  CRISPR gRNA sequence
tagtttttaaaggaatctcc

SEQ ID NO: 812054 - DNA, 20 bp, Artificial
  CRISPR gRNA sequence
agtttttaaaggaatctcca

SEQ ID NO: 812055 - DNA, 20 bp, Artificial
  CRISPR gRNA sequence
gtttttaaaggaatctccac

SEQ ID NO: 812056 - DNA, 20 bp, Artificial
  CRISPR gRNA sequence
ttaaaggaatctccacactg

SEQ ID NO: 812057 - DNA, 20 bp, Artificial
  CRISPR gRNA sequence
taaaggaatctccacactgt

SEQ ID NO: 812058 - DNA, 20 bp, Artificial
  CRISPR gRNA sequence
aaaggaatctccacactgtt

SEQ ID NO: 812059 - DNA, 20 bp, Artificial
  CRISPR gRNA sequence
aaggaatctccacactgttt

SEQ ID NO: 812060 - DNA, 20 bp, Artificial
  CRISPR gRNA sequence
cacactgttttccatagtgg

SEQ ID NO: 812061 - DNA, 20 bp, Artificial
  CRISPR gRNA sequence
ttttccatagtggttgtact

SEQ ID NO: 812062 - DNA, 20 bp, Artificial
  CRISPR gRNA sequence
tccatagtggttgtactagt

SEQ ID NO: 812063 - DNA, 20 bp, Artificial
  CRISPR gRNA sequence
ccatagtggttgtactagtt

SEQ ID NO: 812064 - DNA, 20 bp, Artificial
  CRISPR gRNA sequence
catagtggttgtactagttt

SEQ ID NO: 812065 - DNA, 20 bp, Artificial
  CRISPR gRNA sequence
tactagtttacattcccacc

SEQ ID NO: 812066 - DNA, 20 bp, Artificial
  CRISPR gRNA sequence
gtttacattcccaccaacag

SEQ ID NO: 812067 - DNA, 20 bp, Artificial
  CRISPR gRNA sequence
acattcccaccaacagtgta

SEQ ID NO: 812068 - DNA, 20 bp, Artificial
  CRISPR gRNA sequence
cattcccaccaacagtgtaa

SEQ ID NO: 812069 - DNA, 20 bp, Artificial
  CRISPR gRNA sequence
ccaccaacagtgtaagagtg

SEQ ID NO: 812070 - DNA, 20 bp, Artificial
  CRISPR gRNA sequence
cttttcaccacatccatgcc

SEQ ID NO: 812071 - DNA, 20 bp, Artificial
  CRISPR gRNA sequence
ttttcaccacatccatgcca

SEQ ID NO: 812072 - DNA, 20 bp, Artificial
  CRISPR gRNA sequence
ttcaccacatccatgccaac

SEQ ID NO: 812073 - DNA, 20 bp, Artificial
  CRISPR gRNA sequence
tcaccacatccatgccaaca

SEQ ID NO: 812074 - DNA, 20 bp, Artificial
  CRISPR gRNA sequence
caccacatccatgccaacat

SEQ ID NO: 812075 - DNA, 20 bp, Artificial
  CRISPR gRNA sequence
accacatccatgccaacatc

SEQ ID NO: 812076 - DNA, 20 bp, Artificial
  CRISPR gRNA sequence
ttatttttttgttatggcca

SEQ ID NO: 812077 - DNA, 20 bp, Artificial
  CRISPR gRNA sequence
tttttttgttatggccattc

SEQ ID NO: 812078 - DNA, 20 bp, Artificial
  CRISPR gRNA sequence
ttttgttatggccattcttg

SEQ ID NO: 812079 - DNA, 20 bp, Artificial
  CRISPR gRNA sequence
tttgttatggccattcttgc

SEQ ID NO: 812080 - DNA, 20 bp, Artificial
  CRISPR gRNA sequence
ttgttatggccattcttgca

SEQ ID NO: 812081 - DNA, 20 bp, Artificial
  CRISPR gRNA sequence
tgttatggccattcttgcag

SEQ ID NO: 812082 - DNA, 20 bp, Artificial
  CRISPR gRNA sequence
gttatggccattcttgcagg

SEQ ID NO: 812083 - DNA, 20 bp, Artificial
  CRISPR gRNA sequence
ttatggccattcttgcagga

SEQ ID NO: 812084 - DNA, 20 bp, Artificial
  CRISPR gRNA sequence
tggccattcttgcaggagta

SEQ ID NO: 812085 - DNA, 20 bp, Artificial
  CRISPR gRNA sequence
ttgcaggagtaaggtggtat

SEQ ID NO: 812086 - DNA, 20 bp, Artificial
  CRISPR gRNA sequence
gcaggagtaaggtggtatcg

SEQ ID NO: 812087 - DNA, 20 bp, Artificial
  CRISPR gRNA sequence
caggagtaaggtggtatcgc

SEQ ID NO: 812088 - DNA, 20 bp, Artificial
  CRISPR gRNA sequence
tgatttgcatttccctgaga

SEQ ID NO: 812089 - DNA, 20 bp, Artificial
  CRISPR gRNA sequence
gatttgcatttccctgagaa

SEQ ID NO: 812090 - DNA, 20 bp, Artificial
  CRISPR gRNA sequence
atttgcatttccctgagaat

SEQ ID NO: 812091 - DNA, 20 bp, Artificial
  CRISPR gRNA sequence
gcatttccctgagaattagt

SEQ ID NO: 812092 - DNA, 20 bp, Artificial
  CRISPR gRNA sequence
catttccctgagaattagtg

SEQ ID NO: 812093 - DNA, 20 bp, Artificial
  CRISPR gRNA sequence
ccctgagaattagtgatgtt

SEQ ID NO: 812094 - DNA, 20 bp, Artificial
  CRISPR gRNA sequence
cctgagaattagtgatgttg

SEQ ID NO: 812095 - DNA, 20 bp, Artificial
  CRISPR gRNA sequence
agaattagtgatgttgagca

SEQ ID NO: 812096 - DNA, 20 bp, Artificial
  CRISPR gRNA sequence
gtgatgttgagcatttttcc

SEQ ID NO: 812097 - DNA, 20 bp, Artificial
  CRISPR gRNA sequence
agcatttttccatatgctcg

SEQ ID NO: 812098 - DNA, 20 bp, Artificial
  CRISPR gRNA sequence
ttccatatgctcgttggtca

SEQ ID NO: 812099 - DNA, 20 bp, Artificial
  CRISPR gRNA sequence
tccatatgctcgttggtcat

SEQ ID NO: 812100 - DNA, 20 bp, Artificial
  CRISPR gRNA sequence
ccatatgctcgttggtcatt

SEQ ID NO: 812101 - DNA, 20 bp, Artificial
  CRISPR gRNA sequence
catatgctcgttggtcattt

SEQ ID NO: 812102 - DNA, 20 bp, Artificial
  CRISPR gRNA sequence
gttggtcatttgtgtatctc

SEQ ID NO: 812103 - DNA, 20 bp, Artificial
  CRISPR gRNA sequence
gtcatttgtgtatctccttg

SEQ ID NO: 812104 - DNA, 20 bp, Artificial
  CRISPR gRNA sequence
gtgtatctccttgtgagaat

SEQ ID NO: 812105 - DNA, 20 bp, Artificial
  CRISPR gRNA sequence
tgtatctccttgtgagaatt

SEQ ID NO: 812106 - DNA, 20 bp, Artificial
  CRISPR gRNA sequence
cttgtgagaattgtctattc

SEQ ID NO: 812107 - DNA, 20 bp, Artificial
  CRISPR gRNA sequence
gtgagaattgtctattcatg

SEQ ID NO: 812108 - DNA, 20 bp, Artificial
  CRISPR gRNA sequence
tgagaattgtctattcatgt

SEQ ID NO: 812109 - DNA, 20 bp, Artificial
  CRISPR gRNA sequence
tctattcatgtccttagccc

SEQ ID NO: 812110 - DNA, 20 bp, Artificial
  CRISPR gRNA sequence
ttcatgtccttagcccattt

SEQ ID NO: 812111 - DNA, 20 bp, Artificial
  CRISPR gRNA sequence
atgtccttagcccatttttt

SEQ ID NO: 812112 - DNA, 20 bp, Artificial
  CRISPR gRNA sequence
agcccattttttgatgggat

SEQ ID NO: 812113 - DNA, 20 bp, Artificial
  CRISPR gRNA sequence
gcccattttttgatgggatc

SEQ ID NO: 812114 - DNA, 20 bp, Artificial
  CRISPR gRNA sequence
tttgatgggatcgtttgttt

SEQ ID NO: 812115 - DNA, 20 bp, Artificial
  CRISPR gRNA sequence
ttgatgggatcgtttgtttt

SEQ ID NO: 812116 - DNA, 20 bp, Artificial
  CRISPR gRNA sequence
tgatgggatcgtttgttttt

SEQ ID NO: 812117 - DNA, 20 bp, Artificial
  CRISPR gRNA sequence
gatgggatcgtttgtttttt

SEQ ID NO: 812118 - DNA, 20 bp, Artificial
  CRISPR gRNA sequence
atgggatcgtttgttttttt

SEQ ID NO: 812119 - DNA, 20 bp, Artificial
  CRISPR gRNA sequence
gtttttttcttgctgattta

SEQ ID NO: 812120 - DNA, 20 bp, Artificial
  CRISPR gRNA sequence
tttttttcttgctgatttat

SEQ ID NO: 812121 - DNA, 20 bp, Artificial
  CRISPR gRNA sequence
ttttcttgctgatttatttg

SEQ ID NO: 812122 - DNA, 20 bp, Artificial
  CRISPR gRNA sequence
tttcttgctgatttatttgc

SEQ ID NO: 812123 - DNA, 20 bp, Artificial
  CRISPR gRNA sequence
ttcttgctgatttatttgca

SEQ ID NO: 812124 - DNA, 20 bp, Artificial
  CRISPR gRNA sequence
tcttgctgatttatttgcat

SEQ ID NO: 812125 - DNA, 20 bp, Artificial
  CRISPR gRNA sequence
cttgctgatttatttgcata

SEQ ID NO: 812126 - DNA, 20 bp, Artificial
  CRISPR gRNA sequence
ttgctgatttatttgcatac

SEQ ID NO: 812127 - DNA, 20 bp, Artificial
  CRISPR gRNA sequence
gctgatttatttgcatacct

SEQ ID NO: 812128 - DNA, 20 bp, Artificial
  CRISPR gRNA sequence
ctgatttatttgcatacctt

SEQ ID NO: 812129 - DNA, 20 bp, Artificial
  CRISPR gRNA sequence
atttatttgcataccttgta

SEQ ID NO: 812130 - DNA, 20 bp, Artificial
  CRISPR gRNA sequence
atttgcataccttgtagatt

SEQ ID NO: 812131 - DNA, 20 bp, Artificial
  CRISPR gRNA sequence
tttgcataccttgtagattc

SEQ ID NO: 812132 - DNA, 20 bp, Artificial
  CRISPR gRNA sequence
gcataccttgtagattctgg

SEQ ID NO: 812133 - DNA, 20 bp, Artificial
  CRISPR gRNA sequence
cataccttgtagattctgga

SEQ ID NO: 812134 - DNA, 20 bp, Artificial
  CRISPR gRNA sequence
gtagattctggatattagtc

SEQ ID NO: 812135 - DNA, 20 bp, Artificial
  CRISPR gRNA sequence
tagattctggatattagtcc

SEQ ID NO: 812136 - DNA, 20 bp, Artificial
  CRISPR gRNA sequence
tggatattagtcctttgtca

SEQ ID NO: 812137 - DNA, 20 bp, Artificial
  CRISPR gRNA sequence
gatattagtcctttgtcaga

SEQ ID NO: 812138 - DNA, 20 bp, Artificial
  CRISPR gRNA sequence
gtcctttgtcagatgtatag

SEQ ID NO: 812139 - DNA, 20 bp, Artificial
  CRISPR gRNA sequence
tgtcagatgtatagattgtg

SEQ ID NO: 812140 - DNA, 20 bp, Artificial
  CRISPR gRNA sequence
gtcagatgtatagattgtga

SEQ ID NO: 812141 - DNA, 20 bp, Artificial
  CRISPR gRNA sequence
tcagatgtatagattgtgaa

SEQ ID NO: 812142 - DNA, 20 bp, Artificial
  CRISPR gRNA sequence
tgaagattttctcccactct

SEQ ID NO: 812143 - DNA, 20 bp, Artificial
  CRISPR gRNA sequence
tctcccactctgtgggttgt

SEQ ID NO: 812144 - DNA, 20 bp, Artificial
  CRISPR gRNA sequence
ctcccactctgtgggttgtc

SEQ ID NO: 812145 - DNA, 20 bp, Artificial
  CRISPR gRNA sequence
tcccactctgtgggttgtct

SEQ ID NO: 812146 - DNA, 20 bp, Artificial
  CRISPR gRNA sequence
ccactctgtgggttgtctgt

SEQ ID NO: 812147 - DNA, 20 bp, Artificial
  CRISPR gRNA sequence
tgtgggttgtctgttaactc

SEQ ID NO: 812148 - DNA, 20 bp, Artificial
  CRISPR gRNA sequence
tgggttgtctgttaactctg

SEQ ID NO: 812149 - DNA, 20 bp, Artificial
  CRISPR gRNA sequence
tctgttaactctgctgatta

SEQ ID NO: 812150 - DNA, 20 bp, Artificial
  CRISPR gRNA sequence
ttaactctgctgattatttc

SEQ ID NO: 812151 - DNA, 20 bp, Artificial
  CRISPR gRNA sequence
actctgctgattatttcttt

SEQ ID NO: 812152 - DNA, 20 bp, Artificial
  CRISPR gRNA sequence
tgctgattatttcttttgct

SEQ ID NO: 812153 - DNA, 20 bp, Artificial
  CRISPR gRNA sequence
ctgattatttcttttgctgt

SEQ ID NO: 812154 - DNA, 20 bp, Artificial
  CRISPR gRNA sequence
attatttcttttgctgtgca

SEQ ID NO: 812155 - DNA, 20 bp, Artificial
  CRISPR gRNA sequence
tttcttttgctgtgcagaag

SEQ ID NO: 812156 - DNA, 20 bp, Artificial
  CRISPR gRNA sequence
cttttgctgtgcagaagctt

SEQ ID NO: 812157 - DNA, 20 bp, Artificial
  CRISPR gRNA sequence
ttttgctgtgcagaagcttt

SEQ ID NO: 812158 - DNA, 20 bp, Artificial
  CRISPR gRNA sequence
ttgctgtgcagaagcttttt

SEQ ID NO: 812159 - DNA, 20 bp, Artificial
  CRISPR gRNA sequence
tgctgtgcagaagcttttta

SEQ ID NO: 812160 - DNA, 20 bp, Artificial
  CRISPR gRNA sequence
gctgtgcagaagctttttag

SEQ ID NO: 812161 - DNA, 20 bp, Artificial
  CRISPR gRNA sequence
ctgtgcagaagctttttagt

SEQ ID NO: 812162 - DNA, 20 bp, Artificial
  CRISPR gRNA sequence
tgcagaagctttttagttta

SEQ ID NO: 812163 - DNA, 20 bp, Artificial
  CRISPR gRNA sequence
tttagtttaattaagtccct

SEQ ID NO: 812164 - DNA, 20 bp, Artificial
  CRISPR gRNA sequence
ttagtttaattaagtcccta

SEQ ID NO: 812165 - DNA, 20 bp, Artificial
  CRISPR gRNA sequence
tagtttaattaagtccctat

SEQ ID NO: 812166 - DNA, 20 bp, Artificial
  CRISPR gRNA sequence
agtttaattaagtccctatt

SEQ ID NO: 812167 - DNA, 20 bp, Artificial
  CRISPR gRNA sequence
gtttaattaagtccctattt

SEQ ID NO: 812168 - DNA, 20 bp, Artificial
  CRISPR gRNA sequence
aattaagtccctatttatct

SEQ ID NO: 812169 - DNA, 20 bp, Artificial
  CRISPR gRNA sequence
attaagtccctatttatcta

SEQ ID NO: 812170 - DNA, 20 bp, Artificial
  CRISPR gRNA sequence
agtccctatttatctattta

SEQ ID NO: 812171 - DNA, 20 bp, Artificial
  CRISPR gRNA sequence
tttatctatttacctttgtc

SEQ ID NO: 812172 - DNA, 20 bp, Artificial
  CRISPR gRNA sequence
atctatttacctttgtcttt

SEQ ID NO: 812173 - DNA, 20 bp, Artificial
  CRISPR gRNA sequence
tctatttacctttgtctttg

SEQ ID NO: 812174 - DNA, 20 bp, Artificial
  CRISPR gRNA sequence
tttacctttgtctttgttgc

SEQ ID NO: 812175 - DNA, 20 bp, Artificial
  CRISPR gRNA sequence
acctttgtctttgttgcatt

SEQ ID NO: 812176 - DNA, 20 bp, Artificial
  CRISPR gRNA sequence
cctttgtctttgttgcattt

SEQ ID NO: 812177 - DNA, 20 bp, Artificial
  CRISPR gRNA sequence
tgtctttgttgcatttgctt

SEQ ID NO: 812178 - DNA, 20 bp, Artificial
  CRISPR gRNA sequence
gtctttgttgcatttgcttt

SEQ ID NO: 812179 - DNA, 20 bp, Artificial
  CRISPR gRNA sequence
tctttgttgcatttgctttt

SEQ ID NO: 812180 - DNA, 20 bp, Artificial
  CRISPR gRNA sequence
tgttgcatttgcttttgggt

SEQ ID NO: 812181 - DNA, 20 bp, Artificial
  CRISPR gRNA sequence
gttgcatttgcttttgggtt

SEQ ID NO: 812182 - DNA, 20 bp, Artificial
  CRISPR gRNA sequence
ttgcatttgcttttgggttc

SEQ ID NO: 812183 - DNA, 20 bp, Artificial
  CRISPR gRNA sequence
catttgcttttgggttcttg

SEQ ID NO: 812184 - DNA, 20 bp, Artificial
  CRISPR gRNA sequence
gcttttgggttcttggtcac

SEQ ID NO: 812185 - DNA, 20 bp, Artificial
  CRISPR gRNA sequence
cttttgggttcttggtcacg

SEQ ID NO: 812186 - DNA, 20 bp, Artificial
  CRISPR gRNA sequence
ttgggttcttggtcacgaag

SEQ ID NO: 812187 - DNA, 20 bp, Artificial
  CRISPR gRNA sequence
tgggttcttggtcacgaagt

SEQ ID NO: 812188 - DNA, 20 bp, Artificial
  CRISPR gRNA sequence
gggttcttggtcacgaagtc

SEQ ID NO: 812189 - DNA, 20 bp, Artificial
  CRISPR gRNA sequence
ggttcttggtcacgaagtct

SEQ ID NO: 812190 - DNA, 20 bp, Artificial
  CRISPR gRNA sequence
ttggtcacgaagtctttgcc

SEQ ID NO: 812191 - DNA, 20 bp, Artificial
  CRISPR gRNA sequence
ggtcacgaagtctttgccta

SEQ ID NO: 812192 - DNA, 20 bp, Artificial
  CRISPR gRNA sequence
gtcacgaagtctttgcctaa

SEQ ID NO: 812193 - DNA, 20 bp, Artificial
  CRISPR gRNA sequence
tgcctaagctaatgtctaga

SEQ ID NO: 812194 - DNA, 20 bp, Artificial
  CRISPR gRNA sequence
gcctaagctaatgtctagaa

SEQ ID NO: 812195 - DNA, 20 bp, Artificial
  CRISPR gRNA sequence
cctaagctaatgtctagaag

SEQ ID NO: 812196 - DNA, 20 bp, Artificial
  CRISPR gRNA sequence
agctaatgtctagaagggct

SEQ ID NO: 812197 - DNA, 20 bp, Artificial
  CRISPR gRNA sequence
atgtctagaagggctttttc

SEQ ID NO: 812198 - DNA, 20 bp, Artificial
  CRISPR gRNA sequence
gaagggctttttcgatgtta

SEQ ID NO: 812199 - DNA, 20 bp, Artificial
  CRISPR gRNA sequence
tttcgatgttatcttctaga

SEQ ID NO: 812200 - DNA, 20 bp, Artificial
  CRISPR gRNA sequence
ttcgatgttatcttctagaa

SEQ ID NO: 812201 - DNA, 20 bp, Artificial
  CRISPR gRNA sequence
tcgatgttatcttctagaat

SEQ ID NO: 812202 - DNA, 20 bp, Artificial
  CRISPR gRNA sequence
cgatgttatcttctagaatc

SEQ ID NO: 812203 - DNA, 20 bp, Artificial
  CRISPR gRNA sequence
gatgttatcttctagaatcg

SEQ ID NO: 812204 - DNA, 20 bp, Artificial
  CRISPR gRNA sequence
tcttctagaatcgttatggt

SEQ ID NO: 812205 - DNA, 20 bp, Artificial
  CRISPR gRNA sequence
ctagaatcgttatggtttca

SEQ ID NO: 812206 - DNA, 20 bp, Artificial
  CRISPR gRNA sequence
tagaatcgttatggtttcag

SEQ ID NO: 812207 - DNA, 20 bp, Artificial
  CRISPR gRNA sequence
gaatcgttatggtttcaggt

SEQ ID NO: 812208 - DNA, 20 bp, Artificial
  CRISPR gRNA sequence
tggtttcaggtcttagattt

SEQ ID NO: 812209 - DNA, 20 bp, Artificial
  CRISPR gRNA sequence
caggtcttagatttaagtct

SEQ ID NO: 812210 - DNA, 20 bp, Artificial
  CRISPR gRNA sequence
aggtcttagatttaagtctt

SEQ ID NO: 812211 - DNA, 20 bp, Artificial
  CRISPR gRNA sequence
agatttaagtctttgatcca

SEQ ID NO: 812212 - DNA, 20 bp, Artificial
  CRISPR gRNA sequence
gatttaagtctttgatccat

SEQ ID NO: 812213 - DNA, 20 bp, Artificial
  CRISPR gRNA sequence
aagtctttgatccatcttga

SEQ ID NO: 812214 - DNA, 20 bp, Artificial
  CRISPR gRNA sequence
agtctttgatccatcttgag

SEQ ID NO: 812215 - DNA, 20 bp, Artificial
  CRISPR gRNA sequence
tgatccatcttgagttgatt

SEQ ID NO: 812216 - DNA, 20 bp, Artificial
  CRISPR gRNA sequence
gatccatcttgagttgattt

SEQ ID NO: 812217 - DNA, 20 bp, Artificial
  CRISPR gRNA sequence
atccatcttgagttgatttt

SEQ ID NO: 812218 - DNA, 20 bp, Artificial
  CRISPR gRNA sequence
gagttgattttttataaggt

SEQ ID NO: 812219 - DNA, 20 bp, Artificial
  CRISPR gRNA sequence
agttgattttttataaggta

SEQ ID NO: 812220 - DNA, 20 bp, Artificial
  CRISPR gRNA sequence
attttttataaggtaagata

SEQ ID NO: 812221 - DNA, 20 bp, Artificial
  CRISPR gRNA sequence
tttataaggtaagatatgag

SEQ ID NO: 812222 - DNA, 20 bp, Artificial
  CRISPR gRNA sequence
ttataaggtaagatatgagg

SEQ ID NO: 812223 - DNA, 20 bp, Artificial
  CRISPR gRNA sequence
tataaggtaagatatgagga

SEQ ID NO: 812224 - DNA, 20 bp, Artificial
  CRISPR gRNA sequence
ataaggtaagatatgaggat

SEQ ID NO: 812225 - DNA, 20 bp, Artificial
  CRISPR gRNA sequence
taaggtaagatatgaggatc

SEQ ID NO: 812226 - DNA, 20 bp, Artificial
  CRISPR gRNA sequence
attcttctccatgtggctag

SEQ ID NO: 812227 - DNA, 20 bp, Artificial
  CRISPR gRNA sequence
ttcttctccatgtggctagc

SEQ ID NO: 812228 - DNA, 20 bp, Artificial
  CRISPR gRNA sequence
ttctccatgtggctagccaa

SEQ ID NO: 812229 - DNA, 20 bp, Artificial
  CRISPR gRNA sequence
ctccatgtggctagccaatt

SEQ ID NO: 812230 - DNA, 20 bp, Artificial
  CRISPR gRNA sequence
tccatgtggctagccaatta

SEQ ID NO: 812231 - DNA, 20 bp, Artificial
  CRISPR gRNA sequence
catgtggctagccaattatc

SEQ ID NO: 812232 - DNA, 20 bp, Artificial
  CRISPR gRNA sequence
gccaattatcccagcaccgt

SEQ ID NO: 812233 - DNA, 20 bp, Artificial
  CRISPR gRNA sequence
tcccagcaccgtttgttgaa

SEQ ID NO: 812234 - DNA, 20 bp, Artificial
  CRISPR gRNA sequence
gttgaataggatgtactttc

SEQ ID NO: 812235 - DNA, 20 bp, Artificial
  CRISPR gRNA sequence
ttgaataggatgtactttcc

SEQ ID NO: 812236 - DNA, 20 bp, Artificial
  CRISPR gRNA sequence
aataggatgtactttcccca

SEQ ID NO: 812237 - DNA, 20 bp, Artificial
  CRISPR gRNA sequence
tccccactttatgtttttgt

SEQ ID NO: 812238 - DNA, 20 bp, Artificial
  CRISPR gRNA sequence
ccccactttatgtttttgtt

SEQ ID NO: 812239 - DNA, 20 bp, Artificial
  CRISPR gRNA sequence
cccactttatgtttttgttt

SEQ ID NO: 812240 - DNA, 20 bp, Artificial
  CRISPR gRNA sequence
tatgtttttgtttgctttgt

SEQ ID NO: 812241 - DNA, 20 bp, Artificial
  CRISPR gRNA sequence
atgtttttgtttgctttgtc

SEQ ID NO: 812242 - DNA, 20 bp, Artificial
  CRISPR gRNA sequence
tgtttttgtttgctttgtca

SEQ ID NO: 812243 - DNA, 20 bp, Artificial
  CRISPR gRNA sequence
ttgtttgctttgtcaaagat

SEQ ID NO: 812244 - DNA, 20 bp, Artificial
  CRISPR gRNA sequence
tgtttgctttgtcaaagatc

SEQ ID NO: 812245 - DNA, 20 bp, Artificial
  CRISPR gRNA sequence
gtttgctttgtcaaagatca

SEQ ID NO: 812246 - DNA, 20 bp, Artificial
  CRISPR gRNA sequence
tttgctttgtcaaagatcag

SEQ ID NO: 812247 - DNA, 20 bp, Artificial
  CRISPR gRNA sequence
gctttgtcaaagatcagttg

SEQ ID NO: 812248 - DNA, 20 bp, Artificial
  CRISPR gRNA sequence
ctttgtcaaagatcagttgg

SEQ ID NO: 812249 - DNA, 20 bp, Artificial
  CRISPR gRNA sequence
tgtcaaagatcagttggcta

SEQ ID NO: 812250 - DNA, 20 bp, Artificial
  CRISPR gRNA sequence
gtcaaagatcagttggctat

SEQ ID NO: 812251 - DNA, 20 bp, Artificial
  CRISPR gRNA sequence
tcaaagatcagttggctata

SEQ ID NO: 812252 - DNA, 20 bp, Artificial
  CRISPR gRNA sequence
gctataagtatttggcttta

SEQ ID NO: 812253 - DNA, 20 bp, Artificial
  CRISPR gRNA sequence
taagtatttggctttattcc

SEQ ID NO: 812254 - DNA, 20 bp, Artificial
  CRISPR gRNA sequence
ggctttattcctaggttctc

SEQ ID NO: 812255 - DNA, 20 bp, Artificial
  CRISPR gRNA sequence
gctttattcctaggttctcc

SEQ ID NO: 812256 - DNA, 20 bp, Artificial
  CRISPR gRNA sequence
tattcctaggttctccgttt

SEQ ID NO: 812257 - DNA, 20 bp, Artificial
  CRISPR gRNA sequence
attcctaggttctccgtttt

SEQ ID NO: 812258 - DNA, 20 bp, Artificial
  CRISPR gRNA sequence
ttcctaggttctccgttttg

SEQ ID NO: 812259 - DNA, 20 bp, Artificial
  CRISPR gRNA sequence
ctaggttctccgttttgttc

SEQ ID NO: 812260 - DNA, 20 bp, Artificial
  CRISPR gRNA sequence
ggttctccgttttgttccat

SEQ ID NO: 812261 - DNA, 20 bp, Artificial
  CRISPR gRNA sequence
tccgttttgttccattggtc

SEQ ID NO: 812262 - DNA, 20 bp, Artificial
  CRISPR gRNA sequence
cgttttgttccattggtcta

SEQ ID NO: 812263 - DNA, 20 bp, Artificial
  CRISPR gRNA sequence
tgttccattggtctatgtgc

SEQ ID NO: 812264 - DNA, 20 bp, Artificial
  CRISPR gRNA sequence
gttccattggtctatgtgcc

SEQ ID NO: 812265 - DNA, 20 bp, Artificial
  CRISPR gRNA sequence
ttccattggtctatgtgcct

SEQ ID NO: 812266 - DNA, 20 bp, Artificial
  CRISPR gRNA sequence
cattggtctatgtgcctatt

SEQ ID NO: 812267 - DNA, 20 bp, Artificial
  CRISPR gRNA sequence
gtctatgtgcctatttttat

SEQ ID NO: 812268 - DNA, 20 bp, Artificial
  CRISPR gRNA sequence
tgtgcctatttttatactag

SEQ ID NO: 812269 - DNA, 20 bp, Artificial
  CRISPR gRNA sequence
tttttatactagtattatgc

SEQ ID NO: 812270 - DNA, 20 bp, Artificial
  CRISPR gRNA sequence
ttatactagtattatgctgt

SEQ ID NO: 812271 - DNA, 20 bp, Artificial
  CRISPR gRNA sequence
tatactagtattatgctgtt

SEQ ID NO: 812272 - DNA, 20 bp, Artificial
  CRISPR gRNA sequence
atactagtattatgctgttt

SEQ ID NO: 812273 - DNA, 20 bp, Artificial
  CRISPR gRNA sequence
tactagtattatgctgtttt

SEQ ID NO: 812274 - DNA, 20 bp, Artificial
  CRISPR gRNA sequence
gtattatgctgttttggtga

SEQ ID NO: 812275 - DNA, 20 bp, Artificial
  CRISPR gRNA sequence
tgctgttttggtgactatgg

SEQ ID NO: 812276 - DNA, 20 bp, Artificial
  CRISPR gRNA sequence
ttttggtgactatggtgtta

SEQ ID NO: 812277 - DNA, 20 bp, Artificial
  CRISPR gRNA sequence
tggtgactatggtgttatag

SEQ ID NO: 812278 - DNA, 20 bp, Artificial
  CRISPR gRNA sequence
ggtgactatggtgttatagt

SEQ ID NO: 812279 - DNA, 20 bp, Artificial
  CRISPR gRNA sequence
gtgactatggtgttatagta

SEQ ID NO: 812280 - DNA, 20 bp, Artificial
  CRISPR gRNA sequence
tggtgttatagtatggtttg

SEQ ID NO: 812281 - DNA, 20 bp, Artificial
  CRISPR gRNA sequence
tagtatggtttgaagttagg

SEQ ID NO: 812282 - DNA, 20 bp, Artificial
  CRISPR gRNA sequence
gaagttaggcaatgtgatgc

SEQ ID NO: 812283 - DNA, 20 bp, Artificial
  CRISPR gRNA sequence
aagttaggcaatgtgatgcc

SEQ ID NO: 812284 - DNA, 20 bp, Artificial
  CRISPR gRNA sequence
ggcaatgtgatgcctccagg

SEQ ID NO: 812285 - DNA, 20 bp, Artificial
  CRISPR gRNA sequence
caggtttgttctttttgctt

SEQ ID NO: 812286 - DNA, 20 bp, Artificial
  CRISPR gRNA sequence
gttctttttgcttagtcttc

SEQ ID NO: 812287 - DNA, 20 bp, Artificial
  CRISPR gRNA sequence
ttctttttgcttagtcttcc

SEQ ID NO: 812288 - DNA, 20 bp, Artificial
  CRISPR gRNA sequence
tttttgcttagtcttccttg

SEQ ID NO: 812289 - DNA, 20 bp, Artificial
  CRISPR gRNA sequence
tttgcttagtcttccttgct

SEQ ID NO: 812290 - DNA, 20 bp, Artificial
  CRISPR gRNA sequence
ttgcttagtcttccttgctt

SEQ ID NO: 812291 - DNA, 20 bp, Artificial
  CRISPR gRNA sequence
tgcttagtcttccttgcttt

SEQ ID NO: 812292 - DNA, 20 bp, Artificial
  CRISPR gRNA sequence
gcttagtcttccttgctttg

SEQ ID NO: 812293 - DNA, 20 bp, Artificial
  CRISPR gRNA sequence
cttagtcttccttgctttgg

SEQ ID NO: 812294 - DNA, 20 bp, Artificial
  CRISPR gRNA sequence
agtcttccttgctttggcta

SEQ ID NO: 812295 - DNA, 20 bp, Artificial
  CRISPR gRNA sequence
gtcttccttgctttggctat

SEQ ID NO: 812296 - DNA, 20 bp, Artificial
  CRISPR gRNA sequence
ccttgctttggctatgtggg

SEQ ID NO: 812297 - DNA, 20 bp, Artificial
  CRISPR gRNA sequence
cttgctttggctatgtgggc

SEQ ID NO: 812298 - DNA, 20 bp, Artificial
  CRISPR gRNA sequence
gctttggctatgtgggctct

SEQ ID NO: 812299 - DNA, 20 bp, Artificial
  CRISPR gRNA sequence
ctttggctatgtgggctctt

SEQ ID NO: 812300 - DNA, 20 bp, Artificial
  CRISPR gRNA sequence
tggctatgtgggctcttttt

SEQ ID NO: 812301 - DNA, 20 bp, Artificial
  CRISPR gRNA sequence
ggctatgtgggctctttttt

SEQ ID NO: 812302 - DNA, 20 bp, Artificial
  CRISPR gRNA sequence
gctatgtgggctcttttttg

SEQ ID NO: 812303 - DNA, 20 bp, Artificial
  CRISPR gRNA sequence
tgtgggctcttttttggttc

SEQ ID NO: 812304 - DNA, 20 bp, Artificial
  CRISPR gRNA sequence
ttttttggttccatatgaat

SEQ ID NO: 812305 - DNA, 20 bp, Artificial
  CRISPR gRNA sequence
ttttggttccatatgaattt

SEQ ID NO: 812306 - DNA, 20 bp, Artificial
  CRISPR gRNA sequence
tttggttccatatgaatttt

SEQ ID NO: 812307 - DNA, 20 bp, Artificial
  CRISPR gRNA sequence
ttggttccatatgaatttta

SEQ ID NO: 812308 - DNA, 20 bp, Artificial
  CRISPR gRNA sequence
tggttccatatgaattttag

SEQ ID NO: 812309 - DNA, 20 bp, Artificial
  CRISPR gRNA sequence
ggttccatatgaattttagg

SEQ ID NO: 812310 - DNA, 20 bp, Artificial
  CRISPR gRNA sequence
gttccatatgaattttagga

SEQ ID NO: 812311 - DNA, 20 bp, Artificial
  CRISPR gRNA sequence
catatgaattttaggatttc

SEQ ID NO: 812312 - DNA, 20 bp, Artificial
  CRISPR gRNA sequence
taggatttctttttctactt

SEQ ID NO: 812313 - DNA, 20 bp, Artificial
  CRISPR gRNA sequence
aggatttctttttctacttt

SEQ ID NO: 812314 - DNA, 20 bp, Artificial
  CRISPR gRNA sequence
ggatttctttttctactttt

SEQ ID NO: 812315 - DNA, 20 bp, Artificial
  CRISPR gRNA sequence
ctttttctacttttgtgaag

SEQ ID NO: 812316 - DNA, 20 bp, Artificial
  CRISPR gRNA sequence
tttttctacttttgtgaaga

SEQ ID NO: 812317 - DNA, 20 bp, Artificial
  CRISPR gRNA sequence
tttctacttttgtgaagaat

SEQ ID NO: 812318 - DNA, 20 bp, Artificial
  CRISPR gRNA sequence
ttctacttttgtgaagaatg

SEQ ID NO: 812319 - DNA, 20 bp, Artificial
  CRISPR gRNA sequence
tctacttttgtgaagaatga

SEQ ID NO: 812320 - DNA, 20 bp, Artificial
  CRISPR gRNA sequence
ctacttttgtgaagaatgat

SEQ ID NO: 812321 - DNA, 20 bp, Artificial
  CRISPR gRNA sequence
tacttttgtgaagaatgatg

SEQ ID NO: 812322 - DNA, 20 bp, Artificial
  CRISPR gRNA sequence
cttttgtgaagaatgatggt

SEQ ID NO: 812323 - DNA, 20 bp, Artificial
  CRISPR gRNA sequence
ttgtgaagaatgatggtagt

SEQ ID NO: 812324 - DNA, 20 bp, Artificial
  CRISPR gRNA sequence
tgtgaagaatgatggtagta

SEQ ID NO: 812325 - DNA, 20 bp, Artificial
  CRISPR gRNA sequence
gtgaagaatgatggtagtat

SEQ ID NO: 812326 - DNA, 20 bp, Artificial
  CRISPR gRNA sequence
tgaagaatgatggtagtatt

SEQ ID NO: 812327 - DNA, 20 bp, Artificial
  CRISPR gRNA sequence
tgatggggattgcattgact

SEQ ID NO: 812328 - DNA, 20 bp, Artificial
  CRISPR gRNA sequence
gatggggattgcattgactt

SEQ ID NO: 812329 - DNA, 20 bp, Artificial
  CRISPR gRNA sequence
atggggattgcattgacttt

SEQ ID NO: 812330 - DNA, 20 bp, Artificial
  CRISPR gRNA sequence
cattgactttgtagattgct

SEQ ID NO: 812331 - DNA, 20 bp, Artificial
  CRISPR gRNA sequence
actttgtagattgcttttgc

SEQ ID NO: 812332 - DNA, 20 bp, Artificial
  CRISPR gRNA sequence
tgtagattgcttttgcaatc

SEQ ID NO: 812333 - DNA, 20 bp, Artificial
  CRISPR gRNA sequence
gtagattgcttttgcaatct

SEQ ID NO: 812334 - DNA, 20 bp, Artificial
  CRISPR gRNA sequence
tagattgcttttgcaatcta

SEQ ID NO: 812335 - DNA, 20 bp, Artificial
  CRISPR gRNA sequence
cttttgcaatctacaaagta

SEQ ID NO: 812336 - DNA, 20 bp, Artificial
  CRISPR gRNA sequence
ttgcaatctacaaagtatgg

SEQ ID NO: 812337 - DNA, 20 bp, Artificial
  CRISPR gRNA sequence
tgcaatctacaaagtatggt

SEQ ID NO: 812338 - DNA, 20 bp, Artificial
  CRISPR gRNA sequence
gcaatctacaaagtatggtc

SEQ ID NO: 812339 - DNA, 20 bp, Artificial
  CRISPR gRNA sequence
caatctacaaagtatggtca

SEQ ID NO: 812340 - DNA, 20 bp, Artificial
  CRISPR gRNA sequence
caaagtatggtcattttcac

SEQ ID NO: 812341 - DNA, 20 bp, Artificial
  CRISPR gRNA sequence
tcacaatattgattgtacct

SEQ ID NO: 812342 - DNA, 20 bp, Artificial
  CRISPR gRNA sequence
cacaatattgattgtaccta

SEQ ID NO: 812343 - DNA, 20 bp, Artificial
  CRISPR gRNA sequence
acaatattgattgtacctat

SEQ ID NO: 812344 - DNA, 20 bp, Artificial
  CRISPR gRNA sequence
attgtacctattcatgaaca

SEQ ID NO: 812345 - DNA, 20 bp, Artificial
  CRISPR gRNA sequence
tacctattcatgaacatggg

SEQ ID NO: 812346 - DNA, 20 bp, Artificial
  CRISPR gRNA sequence
ttcatgaacatgggatgtgt

SEQ ID NO: 812347 - DNA, 20 bp, Artificial
  CRISPR gRNA sequence
atgaacatgggatgtgtttc

SEQ ID NO: 812348 - DNA, 20 bp, Artificial
  CRISPR gRNA sequence
ccatttgtttgtgtcatctg

SEQ ID NO: 812349 - DNA, 20 bp, Artificial
  CRISPR gRNA sequence
catttgtttgtgtcatctgt

SEQ ID NO: 812350 - DNA, 20 bp, Artificial
  CRISPR gRNA sequence
gtttgtgtcatctgtgattt

SEQ ID NO: 812351 - DNA, 20 bp, Artificial
  CRISPR gRNA sequence
tttgtgtcatctgtgatttc

SEQ ID NO: 812352 - DNA, 20 bp, Artificial
  CRISPR gRNA sequence
gtgtcatctgtgatttcttt

SEQ ID NO: 812353 - DNA, 20 bp, Artificial
  CRISPR gRNA sequence
tgtcatctgtgatttctttc

SEQ ID NO: 812354 - DNA, 20 bp, Artificial
  CRISPR gRNA sequence
tgatttctttcagtagtgat

SEQ ID NO: 812355 - DNA, 20 bp, Artificial
  CRISPR gRNA sequence
ctttcagtagtgatttgtag

SEQ ID NO: 812356 - DNA, 20 bp, Artificial
  CRISPR gRNA sequence
tttcagtagtgatttgtagt

SEQ ID NO: 812357 - DNA, 20 bp, Artificial
  CRISPR gRNA sequence
tcagtagtgatttgtagttt

SEQ ID NO: 812358 - DNA, 20 bp, Artificial
  CRISPR gRNA sequence
cagtagtgatttgtagtttt

SEQ ID NO: 812359 - DNA, 20 bp, Artificial
  CRISPR gRNA sequence
agtagtgatttgtagttttc

SEQ ID NO: 812360 - DNA, 20 bp, Artificial
  CRISPR gRNA sequence
gtagttttccttgtagaggt

SEQ ID NO: 812361 - DNA, 20 bp, Artificial
  CRISPR gRNA sequence
tagttttccttgtagaggtc

SEQ ID NO: 812362 - DNA, 20 bp, Artificial
  CRISPR gRNA sequence
tccttgtagaggtctttcat

SEQ ID NO: 812363 - DNA, 20 bp, Artificial
  CRISPR gRNA sequence
ccttgtagaggtctttcatg

SEQ ID NO: 812364 - DNA, 20 bp, Artificial
  CRISPR gRNA sequence
cttgtagaggtctttcatgt

SEQ ID NO: 812365 - DNA, 20 bp, Artificial
  CRISPR gRNA sequence
gtagaggtctttcatgtcct

SEQ ID NO: 812366 - DNA, 20 bp, Artificial
  CRISPR gRNA sequence
tagaggtctttcatgtcctt

SEQ ID NO: 812367 - DNA, 20 bp, Artificial
  CRISPR gRNA sequence
tcatgtccttcgttaggtat

SEQ ID NO: 812368 - DNA, 20 bp, Artificial
  CRISPR gRNA sequence
catgtccttcgttaggtata

SEQ ID NO: 812369 - DNA, 20 bp, Artificial
  CRISPR gRNA sequence
atgtccttcgttaggtatat

SEQ ID NO: 812370 - DNA, 20 bp, Artificial
  CRISPR gRNA sequence
cgttaggtatattcctaagt

SEQ ID NO: 812371 - DNA, 20 bp, Artificial
  CRISPR gRNA sequence
gttaggtatattcctaagta

SEQ ID NO: 812372 - DNA, 20 bp, Artificial
  CRISPR gRNA sequence
ggtatattcctaagtatttt

SEQ ID NO: 812373 - DNA, 20 bp, Artificial
  CRISPR gRNA sequence
ctaagtattttattttattt

SEQ ID NO: 812374 - DNA, 20 bp, Artificial
  CRISPR gRNA sequence
agtattttattttatttttg

SEQ ID NO: 812375 - DNA, 20 bp, Artificial
  CRISPR gRNA sequence
tattttatttttgcagctat

SEQ ID NO: 812376 - DNA, 20 bp, Artificial
  CRISPR gRNA sequence
attttatttttgcagctatt

SEQ ID NO: 812377 - DNA, 20 bp, Artificial
  CRISPR gRNA sequence
ttttatttttgcagctattg

SEQ ID NO: 812378 - DNA, 20 bp, Artificial
  CRISPR gRNA sequence
tatttttgcagctattggtt

SEQ ID NO: 812379 - DNA, 20 bp, Artificial
  CRISPR gRNA sequence
atttttgcagctattggttg

SEQ ID NO: 812380 - DNA, 20 bp, Artificial
  CRISPR gRNA sequence
tttttgcagctattggttga

SEQ ID NO: 812381 - DNA, 20 bp, Artificial
  CRISPR gRNA sequence
ttgcagctattggttgatgt

SEQ ID NO: 812382 - DNA, 20 bp, Artificial
  CRISPR gRNA sequence
tgcagctattggttgatgtt

SEQ ID NO: 812383 - DNA, 20 bp, Artificial
  CRISPR gRNA sequence
gcagctattggttgatgttg

SEQ ID NO: 812384 - DNA, 20 bp, Artificial
  CRISPR gRNA sequence
cagctattggttgatgttgg

SEQ ID NO: 812385 - DNA, 20 bp, Artificial
  CRISPR gRNA sequence
ttggttgatgttggtgtata

SEQ ID NO: 812386 - DNA, 20 bp, Artificial
  CRISPR gRNA sequence
gttgatgttggtgtatagca

SEQ ID NO: 812387 - DNA, 20 bp, Artificial
  CRISPR gRNA sequence
atgttggtgtatagcagagc

SEQ ID NO: 812388 - DNA, 20 bp, Artificial
  CRISPR gRNA sequence
gtgtatagcagagctactga

SEQ ID NO: 812389 - DNA, 20 bp, Artificial
  CRISPR gRNA sequence
ctgatttgtgtacattaatt

SEQ ID NO: 812390 - DNA, 20 bp, Artificial
  CRISPR gRNA sequence
atttgtgtacattaattttg

SEQ ID NO: 812391 - DNA, 20 bp, Artificial
  CRISPR gRNA sequence
gtgtacattaattttgtatc

SEQ ID NO: 812392 - DNA, 20 bp, Artificial
  CRISPR gRNA sequence
tgtacattaattttgtatcc

SEQ ID NO: 812393 - DNA, 20 bp, Artificial
  CRISPR gRNA sequence
attttgtatcctgaaacttt

SEQ ID NO: 812394 - DNA, 20 bp, Artificial
  CRISPR gRNA sequence
tgtatcctgaaactttgctg

SEQ ID NO: 812395 - DNA, 20 bp, Artificial
  CRISPR gRNA sequence
gtatcctgaaactttgctga

SEQ ID NO: 812396 - DNA, 20 bp, Artificial
  CRISPR gRNA sequence
tatcctgaaactttgctgaa

SEQ ID NO: 812397 - DNA, 20 bp, Artificial
  CRISPR gRNA sequence
aaactttgctgaatttgttt

SEQ ID NO: 812398 - DNA, 20 bp, Artificial
  CRISPR gRNA sequence
tgctgaatttgtttaccagt

SEQ ID NO: 812399 - DNA, 20 bp, Artificial
  CRISPR gRNA sequence
gctgaatttgtttaccagtt

SEQ ID NO: 812400 - DNA, 20 bp, Artificial
  CRISPR gRNA sequence
ctgaatttgtttaccagttc

SEQ ID NO: 812401 - DNA, 20 bp, Artificial
  CRISPR gRNA sequence
aatttgtttaccagttctag

SEQ ID NO: 812402 - DNA, 20 bp, Artificial
  CRISPR gRNA sequence
gtttaccagttctaggagct

SEQ ID NO: 812403 - DNA, 20 bp, Artificial
  CRISPR gRNA sequence
tttaccagttctaggagctt

SEQ ID NO: 812404 - DNA, 20 bp, Artificial
  CRISPR gRNA sequence
accagttctaggagctttca

SEQ ID NO: 812405 - DNA, 20 bp, Artificial
  CRISPR gRNA sequence
ccagttctaggagctttcaa

SEQ ID NO: 812406 - DNA, 20 bp, Artificial
  CRISPR gRNA sequence
taggagctttcaagatgaat

SEQ ID NO: 812407 - DNA, 20 bp, Artificial
  CRISPR gRNA sequence
ggagctttcaagatgaatcc

SEQ ID NO: 812408 - DNA, 20 bp, Artificial
  CRISPR gRNA sequence
tcaagatgaatccttagggt

SEQ ID NO: 812409 - DNA, 20 bp, Artificial
  CRISPR gRNA sequence
caagatgaatccttagggtt

SEQ ID NO: 812410 - DNA, 20 bp, Artificial
  CRISPR gRNA sequence
aagatgaatccttagggttt

SEQ ID NO: 812411 - DNA, 20 bp, Artificial
  CRISPR gRNA sequence
agggttttctaggtatatga

SEQ ID NO: 812412 - DNA, 20 bp, Artificial
  CRISPR gRNA sequence
gggttttctaggtatatgat

SEQ ID NO: 812413 - DNA, 20 bp, Artificial
  CRISPR gRNA sequence
tctaggtatatgatcatatc

SEQ ID NO: 812414 - DNA, 20 bp, Artificial
  CRISPR gRNA sequence
ctaggtatatgatcatatca

SEQ ID NO: 812415 - DNA, 20 bp, Artificial
  CRISPR gRNA sequence
taggtatatgatcatatcat

SEQ ID NO: 812416 - DNA, 20 bp, Artificial
  CRISPR gRNA sequence
ggtatatgatcatatcatca

SEQ ID NO: 812417 - DNA, 20 bp, Artificial
  CRISPR gRNA sequence
gacttcctctttaccaattt

SEQ ID NO: 812418 - DNA, 20 bp, Artificial
  CRISPR gRNA sequence
acttcctctttaccaatttg

SEQ ID NO: 812419 - DNA, 20 bp, Artificial
  CRISPR gRNA sequence
cctctttaccaatttggatg

SEQ ID NO: 812420 - DNA, 20 bp, Artificial
  CRISPR gRNA sequence
ctctttaccaatttggatgc

SEQ ID NO: 812421 - DNA, 20 bp, Artificial
  CRISPR gRNA sequence
tttaccaatttggatgccct

SEQ ID NO: 812422 - DNA, 20 bp, Artificial
  CRISPR gRNA sequence
taccaatttggatgcccttt

SEQ ID NO: 812423 - DNA, 20 bp, Artificial
  CRISPR gRNA sequence
accaatttggatgcccttta

SEQ ID NO: 812424 - DNA, 20 bp, Artificial
  CRISPR gRNA sequence
ccaatttggatgccctttat

SEQ ID NO: 812425 - DNA, 20 bp, Artificial
  CRISPR gRNA sequence
ggatgccctttatttctttc

SEQ ID NO: 812426 - DNA, 20 bp, Artificial
  CRISPR gRNA sequence
gatgccctttatttctttct

SEQ ID NO: 812427 - DNA, 20 bp, Artificial
  CRISPR gRNA sequence
tatttctttctctttgagtg

SEQ ID NO: 812428 - DNA, 20 bp, Artificial
  CRISPR gRNA sequence
atttctttctctttgagtgc

SEQ ID NO: 812429 - DNA, 20 bp, Artificial
  CRISPR gRNA sequence
tttctttctctttgagtgct

SEQ ID NO: 812430 - DNA, 20 bp, Artificial
  CRISPR gRNA sequence
ctttctctttgagtgctctg

SEQ ID NO: 812431 - DNA, 20 bp, Artificial
  CRISPR gRNA sequence
tttctctttgagtgctctgg

SEQ ID NO: 812432 - DNA, 20 bp, Artificial
  CRISPR gRNA sequence
tctctttgagtgctctggcc

SEQ ID NO: 812433 - DNA, 20 bp, Artificial
  CRISPR gRNA sequence
ctctttgagtgctctggcca

SEQ ID NO: 812434 - DNA, 20 bp, Artificial
  CRISPR gRNA sequence
tctttgagtgctctggccag

SEQ ID NO: 812435 - DNA, 20 bp, Artificial
  CRISPR gRNA sequence
tttgagtgctctggccagga

SEQ ID NO: 812436 - DNA, 20 bp, Artificial
  CRISPR gRNA sequence
tgagtgctctggccaggact

SEQ ID NO: 812437 - DNA, 20 bp, Artificial
  CRISPR gRNA sequence
gagtgctctggccaggactt

SEQ ID NO: 812438 - DNA, 20 bp, Artificial
  CRISPR gRNA sequence
agtgctctggccaggacttc

SEQ ID NO: 812439 - DNA, 20 bp, Artificial
  CRISPR gRNA sequence
tggccaggacttccagtact

SEQ ID NO: 812440 - DNA, 20 bp, Artificial
  CRISPR gRNA sequence
gccaggacttccagtactat

SEQ ID NO: 812441 - DNA, 20 bp, Artificial
  CRISPR gRNA sequence
ccagtactatgctgaataaa

SEQ ID NO: 812442 - DNA, 20 bp, Artificial
  CRISPR gRNA sequence
cagtactatgctgaataaaa

SEQ ID NO: 812443 - DNA, 20 bp, Artificial
  CRISPR gRNA sequence
tgctgaataaaagtggtgaa

SEQ ID NO: 812444 - DNA, 20 bp, Artificial
  CRISPR gRNA sequence
aataaaagtggtgaaagtgt

SEQ ID NO: 812445 - DNA, 20 bp, Artificial
  CRISPR gRNA sequence
gtcttgttccaattctcagg

SEQ ID NO: 812446 - DNA, 20 bp, Artificial
  CRISPR gRNA sequence
tcttgttccaattctcaggg

SEQ ID NO: 812447 - DNA, 20 bp, Artificial
  CRISPR gRNA sequence
gttccaattctcagggaaaa

SEQ ID NO: 812448 - DNA, 20 bp, Artificial
  CRISPR gRNA sequence
ttccaattctcagggaaaat

SEQ ID NO: 812449 - DNA, 20 bp, Artificial
  CRISPR gRNA sequence
caattctcagggaaaatgct

SEQ ID NO: 812450 - DNA, 20 bp, Artificial
  CRISPR gRNA sequence
tcagggaaaatgctttcaac

SEQ ID NO: 812451 - DNA, 20 bp, Artificial
  CRISPR gRNA sequence
agggaaaatgctttcaactt

SEQ ID NO: 812452 - DNA, 20 bp, Artificial
  CRISPR gRNA sequence
tcaacttttccccattcagc

SEQ ID NO: 812453 - DNA, 20 bp, Artificial
  CRISPR gRNA sequence
caacttttccccattcagca

SEQ ID NO: 812454 - DNA, 20 bp, Artificial
  CRISPR gRNA sequence
aacttttccccattcagcat

SEQ ID NO: 812455 - DNA, 20 bp, Artificial
  CRISPR gRNA sequence
ttccccattcagcataatgt

SEQ ID NO: 812456 - DNA, 20 bp, Artificial
  CRISPR gRNA sequence
tccccattcagcataatgtt

SEQ ID NO: 812457 - DNA, 20 bp, Artificial
  CRISPR gRNA sequence
ccccattcagcataatgttg

SEQ ID NO: 812458 - DNA, 20 bp, Artificial
  CRISPR gRNA sequence
cccattcagcataatgttgg

SEQ ID NO: 812459 - DNA, 20 bp, Artificial
  CRISPR gRNA sequence
agcataatgttggctgtggg

SEQ ID NO: 812460 - DNA, 20 bp, Artificial
  CRISPR gRNA sequence
gctgtgggtttgtcgtagtt

SEQ ID NO: 812461 - DNA, 20 bp, Artificial
  CRISPR gRNA sequence
tgggtttgtcgtagttagct

SEQ ID NO: 812462 - DNA, 20 bp, Artificial
  CRISPR gRNA sequence
gtcgtagttagcttttatta

SEQ ID NO: 812463 - DNA, 20 bp, Artificial
  CRISPR gRNA sequence
tcgtagttagcttttattac

SEQ ID NO: 812464 - DNA, 20 bp, Artificial
  CRISPR gRNA sequence
gcttttattaccttaagata

SEQ ID NO: 812465 - DNA, 20 bp, Artificial
  CRISPR gRNA sequence
ttattaccttaagatatgtt

SEQ ID NO: 812466 - DNA, 20 bp, Artificial
  CRISPR gRNA sequence
tattaccttaagatatgttc

SEQ ID NO: 812467 - DNA, 20 bp, Artificial
  CRISPR gRNA sequence
attaccttaagatatgttcc

SEQ ID NO: 812468 - DNA, 20 bp, Artificial
  CRISPR gRNA sequence
ttaccttaagatatgttcct

SEQ ID NO: 812469 - DNA, 20 bp, Artificial
  CRISPR gRNA sequence
ccttaagatatgttccttct

SEQ ID NO: 812470 - DNA, 20 bp, Artificial
  CRISPR gRNA sequence
aagatatgttccttctgtgc

SEQ ID NO: 812471 - DNA, 20 bp, Artificial
  CRISPR gRNA sequence
agatatgttccttctgtgct

SEQ ID NO: 812472 - DNA, 20 bp, Artificial
  CRISPR gRNA sequence
cttctgtgctaattttgctg

SEQ ID NO: 812473 - DNA, 20 bp, Artificial
  CRISPR gRNA sequence
ctgtgctaattttgctgagg

SEQ ID NO: 812474 - DNA, 20 bp, Artificial
  CRISPR gRNA sequence
tgtgctaattttgctgaggg

SEQ ID NO: 812475 - DNA, 20 bp, Artificial
  CRISPR gRNA sequence
tgctaattttgctgagggtt

SEQ ID NO: 812476 - DNA, 20 bp, Artificial
  CRISPR gRNA sequence
attttgctgagggttttaat

SEQ ID NO: 812477 - DNA, 20 bp, Artificial
  CRISPR gRNA sequence
tgctgagggttttaatcata

SEQ ID NO: 812478 - DNA, 20 bp, Artificial
  CRISPR gRNA sequence
gctgagggttttaatcataa

SEQ ID NO: 812479 - DNA, 20 bp, Artificial
  CRISPR gRNA sequence
ctgagggttttaatcataaa

SEQ ID NO: 812480 - DNA, 20 bp, Artificial
  CRISPR gRNA sequence
agggttttaatcataaagga

SEQ ID NO: 812481 - DNA, 20 bp, Artificial
  CRISPR gRNA sequence
taatcataaaggatgttaga

SEQ ID NO: 812482 - DNA, 20 bp, Artificial
  CRISPR gRNA sequence
aatcataaaggatgttagat

SEQ ID NO: 812483 - DNA, 20 bp, Artificial
  CRISPR gRNA sequence
atcataaaggatgttagatt

SEQ ID NO: 812484 - DNA, 20 bp, Artificial
  CRISPR gRNA sequence
gattttgtcaaatgcttttt

SEQ ID NO: 812485 - DNA, 20 bp, Artificial
  CRISPR gRNA sequence
tgtcaaatgctttttctgaa

SEQ ID NO: 812486 - DNA, 20 bp, Artificial
  CRISPR gRNA sequence
gtcaaatgctttttctgaat

SEQ ID NO: 812487 - DNA, 20 bp, Artificial
  CRISPR gRNA sequence
tcaaatgctttttctgaatc

SEQ ID NO: 812488 - DNA, 20 bp, Artificial
  CRISPR gRNA sequence
tttctgaatctattgagatg

SEQ ID NO: 812489 - DNA, 20 bp, Artificial
  CRISPR gRNA sequence
ttctgaatctattgagatga

SEQ ID NO: 812490 - DNA, 20 bp, Artificial
  CRISPR gRNA sequence
tctgaatctattgagatgat

SEQ ID NO: 812491 - DNA, 20 bp, Artificial
  CRISPR gRNA sequence
ctgaatctattgagatgatc

SEQ ID NO: 812492 - DNA, 20 bp, Artificial
  CRISPR gRNA sequence
tgaatctattgagatgatca

SEQ ID NO: 812493 - DNA, 20 bp, Artificial
  CRISPR gRNA sequence
aatctattgagatgatcatg

SEQ ID NO: 812494 - DNA, 20 bp, Artificial
  CRISPR gRNA sequence
ttgagatgatcatgtgattt

SEQ ID NO: 812495 - DNA, 20 bp, Artificial
  CRISPR gRNA sequence
agatgatcatgtgatttttg

SEQ ID NO: 812496 - DNA, 20 bp, Artificial
  CRISPR gRNA sequence
ttgtttttaattctgtttgt

SEQ ID NO: 812497 - DNA, 20 bp, Artificial
  CRISPR gRNA sequence
tgtttttaattctgtttgtg

SEQ ID NO: 812498 - DNA, 20 bp, Artificial
  CRISPR gRNA sequence
gtttttaattctgtttgtgt

SEQ ID NO: 812499 - DNA, 20 bp, Artificial
  CRISPR gRNA sequence
tttttaattctgtttgtgtg

SEQ ID NO: 812500 - DNA, 20 bp, Artificial
  CRISPR gRNA sequence
ttaattctgtttgtgtggtg

SEQ ID NO: 812501 - DNA, 20 bp, Artificial
  CRISPR gRNA sequence
taattctgtttgtgtggtgt

SEQ ID NO: 812502 - DNA, 20 bp, Artificial
  CRISPR gRNA sequence
aattctgtttgtgtggtgta

SEQ ID NO: 812503 - DNA, 20 bp, Artificial
  CRISPR gRNA sequence
attctgtttgtgtggtgtat

SEQ ID NO: 812504 - DNA, 20 bp, Artificial
  CRISPR gRNA sequence
tgtttgtgtggtgtatcaca

SEQ ID NO: 812505 - DNA, 20 bp, Artificial
  CRISPR gRNA sequence
tttgtgtggtgtatcacatt

SEQ ID NO: 812506 - DNA, 20 bp, Artificial
  CRISPR gRNA sequence
gtgtggtgtatcacatttat

SEQ ID NO: 812507 - DNA, 20 bp, Artificial
  CRISPR gRNA sequence
tgtggtgtatcacatttatt

SEQ ID NO: 812508 - DNA, 20 bp, Artificial
  CRISPR gRNA sequence
attaacttgtggatgttaaa

SEQ ID NO: 812509 - DNA, 20 bp, Artificial
  CRISPR gRNA sequence
ttaacttgtggatgttaaac

SEQ ID NO: 812510 - DNA, 20 bp, Artificial
  CRISPR gRNA sequence
acttgtggatgttaaaccat

SEQ ID NO: 812511 - DNA, 20 bp, Artificial
  CRISPR gRNA sequence
gtggatgttaaaccatccct

SEQ ID NO: 812512 - DNA, 20 bp, Artificial
  CRISPR gRNA sequence
tggatgttaaaccatccctg

SEQ ID NO: 812513 - DNA, 20 bp, Artificial
  CRISPR gRNA sequence
aaccatccctgcatccctgg

SEQ ID NO: 812514 - DNA, 20 bp, Artificial
  CRISPR gRNA sequence
catccctggtgtaaaaccca

SEQ ID NO: 812515 - DNA, 20 bp, Artificial
  CRISPR gRNA sequence
gtgtaaaacccacttgatca

SEQ ID NO: 812516 - DNA, 20 bp, Artificial
  CRISPR gRNA sequence
gatcatggtggattatcttt

SEQ ID NO: 812517 - DNA, 20 bp, Artificial
  CRISPR gRNA sequence
atcatggtggattatctttt

SEQ ID NO: 812518 - DNA, 20 bp, Artificial
  CRISPR gRNA sequence
tctttttgatatgctgttgg

SEQ ID NO: 812519 - DNA, 20 bp, Artificial
  CRISPR gRNA sequence
tttgatatgctgttggattt

SEQ ID NO: 812520 - DNA, 20 bp, Artificial
  CRISPR gRNA sequence
ttgatatgctgttggatttg

SEQ ID NO: 812521 - DNA, 20 bp, Artificial
  CRISPR gRNA sequence
tgatatgctgttggatttgg

SEQ ID NO: 812522 - DNA, 20 bp, Artificial
  CRISPR gRNA sequence
gatatgctgttggatttggt

SEQ ID NO: 812523 - DNA, 20 bp, Artificial
  CRISPR gRNA sequence
atatgctgttggatttggtt

SEQ ID NO: 812524 - DNA, 20 bp, Artificial
  CRISPR gRNA sequence
ttggatttggttagctagta

SEQ ID NO: 812525 - DNA, 20 bp, Artificial
  CRISPR gRNA sequence
gatttggttagctagtattt

SEQ ID NO: 812526 - DNA, 20 bp, Artificial
  CRISPR gRNA sequence
ggttagctagtattttgttg

SEQ ID NO: 812527 - DNA, 20 bp, Artificial
  CRISPR gRNA sequence
gttagctagtattttgttga

SEQ ID NO: 812528 - DNA, 20 bp, Artificial
  CRISPR gRNA sequence
gctagtattttgttgaggat

SEQ ID NO: 812529 - DNA, 20 bp, Artificial
  CRISPR gRNA sequence
gtattttgttgaggattttt

SEQ ID NO: 812530 - DNA, 20 bp, Artificial
  CRISPR gRNA sequence
tgttgaggatttttacatct

SEQ ID NO: 812531 - DNA, 20 bp, Artificial
  CRISPR gRNA sequence
gttgaggatttttacatcta

SEQ ID NO: 812532 - DNA, 20 bp, Artificial
  CRISPR gRNA sequence
ttgaggatttttacatctat

SEQ ID NO: 812533 - DNA, 20 bp, Artificial
  CRISPR gRNA sequence
aggatttttacatctatgtt

SEQ ID NO: 812534 - DNA, 20 bp, Artificial
  CRISPR gRNA sequence
ttacatctatgttcatcagg

SEQ ID NO: 812535 - DNA, 20 bp, Artificial
  CRISPR gRNA sequence
tacatctatgttcatcaggg

SEQ ID NO: 812536 - DNA, 20 bp, Artificial
  CRISPR gRNA sequence
acatctatgttcatcaggga

SEQ ID NO: 812537 - DNA, 20 bp, Artificial
  CRISPR gRNA sequence
catctatgttcatcagggat

SEQ ID NO: 812538 - DNA, 20 bp, Artificial
  CRISPR gRNA sequence
tgttcatcagggatactggc

SEQ ID NO: 812539 - DNA, 20 bp, Artificial
  CRISPR gRNA sequence
atcagggatactggcctgta

SEQ ID NO: 812540 - DNA, 20 bp, Artificial
  CRISPR gRNA sequence
gcctgtagttttcttttttt

SEQ ID NO: 812541 - DNA, 20 bp, Artificial
  CRISPR gRNA sequence
tagttttctttttttgttat

SEQ ID NO: 812542 - DNA, 20 bp, Artificial
  CRISPR gRNA sequence
tctttttttgttatgtcctt

SEQ ID NO: 812543 - DNA, 20 bp, Artificial
  CRISPR gRNA sequence
ctttttttgttatgtccttc

SEQ ID NO: 812544 - DNA, 20 bp, Artificial
  CRISPR gRNA sequence
tttttttgttatgtccttcc

SEQ ID NO: 812545 - DNA, 20 bp, Artificial
  CRISPR gRNA sequence
tttttgttatgtccttccct

SEQ ID NO: 812546 - DNA, 20 bp, Artificial
  CRISPR gRNA sequence
ttttgttatgtccttccctg

SEQ ID NO: 812547 - DNA, 20 bp, Artificial
  CRISPR gRNA sequence
tttgttatgtccttccctgg

SEQ ID NO: 812548 - DNA, 20 bp, Artificial
  CRISPR gRNA sequence
ttgttatgtccttccctggt

SEQ ID NO: 812549 - DNA, 20 bp, Artificial
  CRISPR gRNA sequence
tgttatgtccttccctggtt

SEQ ID NO: 812550 - DNA, 20 bp, Artificial
  CRISPR gRNA sequence
gttatgtccttccctggttt

SEQ ID NO: 812551 - DNA, 20 bp, Artificial
  CRISPR gRNA sequence
ttatgtccttccctggtttt

SEQ ID NO: 812552 - DNA, 20 bp, Artificial
  CRISPR gRNA sequence
tgtccttccctggtttttgt

SEQ ID NO: 812553 - DNA, 20 bp, Artificial
  CRISPR gRNA sequence
ccctggtttttgtattaggg

SEQ ID NO: 812554 - DNA, 20 bp, Artificial
  CRISPR gRNA sequence
cctggtttttgtattagggt

SEQ ID NO: 812555 - DNA, 20 bp, Artificial
  CRISPR gRNA sequence
gtttttgtattagggtgcta

SEQ ID NO: 812556 - DNA, 20 bp, Artificial
  CRISPR gRNA sequence
ttgtattagggtgctactgg

SEQ ID NO: 812557 - DNA, 20 bp, Artificial
  CRISPR gRNA sequence
tgtattagggtgctactggc

SEQ ID NO: 812558 - DNA, 20 bp, Artificial
  CRISPR gRNA sequence
gtattagggtgctactggct

SEQ ID NO: 812559 - DNA, 20 bp, Artificial
  CRISPR gRNA sequence
tattagggtgctactggctt

SEQ ID NO: 812560 - DNA, 20 bp, Artificial
  CRISPR gRNA sequence
gggtgctactggcttcatag

SEQ ID NO: 812561 - DNA, 20 bp, Artificial
  CRISPR gRNA sequence
ctggcttcatagaatgattt

SEQ ID NO: 812562 - DNA, 20 bp, Artificial
  CRISPR gRNA sequence
gcttcatagaatgatttagg

SEQ ID NO: 812563 - DNA, 20 bp, Artificial
  CRISPR gRNA sequence
catagaatgatttagggagg

SEQ ID NO: 812564 - DNA, 20 bp, Artificial
  CRISPR gRNA sequence
atagaatgatttagggagga

SEQ ID NO: 812565 - DNA, 20 bp, Artificial
  CRISPR gRNA sequence
agggaggattccctctttct

SEQ ID NO: 812566 - DNA, 20 bp, Artificial
  CRISPR gRNA sequence
gggaggattccctctttctc

SEQ ID NO: 812567 - DNA, 20 bp, Artificial
  CRISPR gRNA sequence
cctctttctctatcccatgg

SEQ ID NO: 812568 - DNA, 20 bp, Artificial
  CRISPR gRNA sequence
tttctctatcccatggaata

SEQ ID NO: 812569 - DNA, 20 bp, Artificial
  CRISPR gRNA sequence
tctctatcccatggaatagt

SEQ ID NO: 812570 - DNA, 20 bp, Artificial
  CRISPR gRNA sequence
ctctatcccatggaatagtg

SEQ ID NO: 812571 - DNA, 20 bp, Artificial
  CRISPR gRNA sequence
tctatcccatggaatagtgt

SEQ ID NO: 812572 - DNA, 20 bp, Artificial
  CRISPR gRNA sequence
tatcccatggaatagtgtca

SEQ ID NO: 812573 - DNA, 20 bp, Artificial
  CRISPR gRNA sequence
tcccatggaatagtgtcaat

SEQ ID NO: 812574 - DNA, 20 bp, Artificial
  CRISPR gRNA sequence
gtaccaattcttctttgaat

SEQ ID NO: 812575 - DNA, 20 bp, Artificial
  CRISPR gRNA sequence
ttctttgaatgtctgataga

SEQ ID NO: 812576 - DNA, 20 bp, Artificial
  CRISPR gRNA sequence
ctttgaatgtctgatagaat

SEQ ID NO: 812577 - DNA, 20 bp, Artificial
  CRISPR gRNA sequence
tttgaatgtctgatagaatt

SEQ ID NO: 812578 - DNA, 20 bp, Artificial
  CRISPR gRNA sequence
tgaatgtctgatagaattca

SEQ ID NO: 812579 - DNA, 20 bp, Artificial
  CRISPR gRNA sequence
gaatgtctgatagaattcag

SEQ ID NO: 812580 - DNA, 20 bp, Artificial
  CRISPR gRNA sequence
aatgtctgatagaattcagc

SEQ ID NO: 812581 - DNA, 20 bp, Artificial
  CRISPR gRNA sequence
atagaattcagctatgaatc

SEQ ID NO: 812582 - DNA, 20 bp, Artificial
  CRISPR gRNA sequence
agctatgaatctgtctggtc

SEQ ID NO: 812583 - DNA, 20 bp, Artificial
  CRISPR gRNA sequence
tgaatctgtctggtcctgga

SEQ ID NO: 812584 - DNA, 20 bp, Artificial
  CRISPR gRNA sequence
tctggtcctggatttttttt

SEQ ID NO: 812585 - DNA, 20 bp, Artificial
  CRISPR gRNA sequence
gtcctggatttttttttgtt

SEQ ID NO: 812586 - DNA, 20 bp, Artificial
  CRISPR gRNA sequence
gatttttttttgttgacaat

SEQ ID NO: 812587 - DNA, 20 bp, Artificial
  CRISPR gRNA sequence
ttttttgttgacaattttaa

SEQ ID NO: 812588 - DNA, 20 bp, Artificial
  CRISPR gRNA sequence
tttttgttgacaattttaaa

SEQ ID NO: 812589 - DNA, 20 bp, Artificial
  CRISPR gRNA sequence
ttttgttgacaattttaaaa

SEQ ID NO: 812590 - DNA, 20 bp, Artificial
  CRISPR gRNA sequence
tttgttgacaattttaaaag

SEQ ID NO: 812591 - DNA, 20 bp, Artificial
  CRISPR gRNA sequence
ttgttgacaattttaaaagt

SEQ ID NO: 812592 - DNA, 20 bp, Artificial
  CRISPR gRNA sequence
tgttgacaattttaaaagtt

SEQ ID NO: 812593 - DNA, 20 bp, Artificial
  CRISPR gRNA sequence
gttgacaattttaaaagtta

SEQ ID NO: 812594 - DNA, 20 bp, Artificial
  CRISPR gRNA sequence
ttgacaattttaaaagttac

SEQ ID NO: 812595 - DNA, 20 bp, Artificial
  CRISPR gRNA sequence
acaattttaaaagttaccat

SEQ ID NO: 812596 - DNA, 20 bp, Artificial
  CRISPR gRNA sequence
taaaagttaccattcaatct

SEQ ID NO: 812597 - DNA, 20 bp, Artificial
  CRISPR gRNA sequence
aaaagttaccattcaatctt

SEQ ID NO: 812598 - DNA, 20 bp, Artificial
  CRISPR gRNA sequence
aaagttaccattcaatcttg

SEQ ID NO: 812599 - DNA, 20 bp, Artificial
  CRISPR gRNA sequence
ccattcaatcttgctgcttg

SEQ ID NO: 812600 - DNA, 20 bp, Artificial
  CRISPR gRNA sequence
aatcttgctgcttgttattg

SEQ ID NO: 812601 - DNA, 20 bp, Artificial
  CRISPR gRNA sequence
gctgcttgttattgatctgt

SEQ ID NO: 812602 - DNA, 20 bp, Artificial
  CRISPR gRNA sequence
ctgcttgttattgatctgtt

SEQ ID NO: 812603 - DNA, 20 bp, Artificial
  CRISPR gRNA sequence
cttgttattgatctgtttat

SEQ ID NO: 812604 - DNA, 20 bp, Artificial
  CRISPR gRNA sequence
gttattgatctgtttatagt

SEQ ID NO: 812605 - DNA, 20 bp, Artificial
  CRISPR gRNA sequence
ttattgatctgtttatagtt

SEQ ID NO: 812606 - DNA, 20 bp, Artificial
  CRISPR gRNA sequence
ttgatctgtttatagttcct

SEQ ID NO: 812607 - DNA, 20 bp, Artificial
  CRISPR gRNA sequence
atctgtttatagttcctata

SEQ ID NO: 812608 - DNA, 20 bp, Artificial
  CRISPR gRNA sequence
tttatagttcctatatcttt

SEQ ID NO: 812609 - DNA, 20 bp, Artificial
  CRISPR gRNA sequence
atagttcctatatctttctg

SEQ ID NO: 812610 - DNA, 20 bp, Artificial
  CRISPR gRNA sequence
tagttcctatatctttctgg

SEQ ID NO: 812611 - DNA, 20 bp, Artificial
  CRISPR gRNA sequence
ctatatctttctggtttaat

SEQ ID NO: 812612 - DNA, 20 bp, Artificial
  CRISPR gRNA sequence
tatctttctggtttaatcga

SEQ ID NO: 812613 - DNA, 20 bp, Artificial
  CRISPR gRNA sequence
tctggtttaatcgaagggtt

SEQ ID NO: 812614 - DNA, 20 bp, Artificial
  CRISPR gRNA sequence
ctggtttaatcgaagggttg

SEQ ID NO: 812615 - DNA, 20 bp, Artificial
  CRISPR gRNA sequence
tggtttaatcgaagggttgt

SEQ ID NO: 812616 - DNA, 20 bp, Artificial
  CRISPR gRNA sequence
gtttaatcgaagggttgtat

SEQ ID NO: 812617 - DNA, 20 bp, Artificial
  CRISPR gRNA sequence
aatcgaagggttgtatattt

SEQ ID NO: 812618 - DNA, 20 bp, Artificial
  CRISPR gRNA sequence
atcgaagggttgtatatttc

SEQ ID NO: 812619 - DNA, 20 bp, Artificial
  CRISPR gRNA sequence
tatatttccaggaatgtatc

SEQ ID NO: 812620 - DNA, 20 bp, Artificial
  CRISPR gRNA sequence
ccaggaatgtatccatctcc

SEQ ID NO: 812621 - DNA, 20 bp, Artificial
  CRISPR gRNA sequence
caggaatgtatccatctcct

SEQ ID NO: 812622 - DNA, 20 bp, Artificial
  CRISPR gRNA sequence
ctctagcttttctagtttgt

SEQ ID NO: 812623 - DNA, 20 bp, Artificial
  CRISPR gRNA sequence
tagcttttctagtttgtacg

SEQ ID NO: 812624 - DNA, 20 bp, Artificial
  CRISPR gRNA sequence
gcttttctagtttgtacgtg

SEQ ID NO: 812625 - DNA, 20 bp, Artificial
  CRISPR gRNA sequence
ttctagtttgtacgtgtaaa

SEQ ID NO: 812626 - DNA, 20 bp, Artificial
  CRISPR gRNA sequence
tctagtttgtacgtgtaaag

SEQ ID NO: 812627 - DNA, 20 bp, Artificial
  CRISPR gRNA sequence
ctagtttgtacgtgtaaagg

SEQ ID NO: 812628 - DNA, 20 bp, Artificial
  CRISPR gRNA sequence
tagtttgtacgtgtaaaggt

SEQ ID NO: 812629 - DNA, 20 bp, Artificial
  CRISPR gRNA sequence
gtttgtacgtgtaaaggtgt

SEQ ID NO: 812630 - DNA, 20 bp, Artificial
  CRISPR gRNA sequence
gtacgtgtaaaggtgttcat

SEQ ID NO: 812631 - DNA, 20 bp, Artificial
  CRISPR gRNA sequence
tacgtgtaaaggtgttcata

SEQ ID NO: 812632 - DNA, 20 bp, Artificial
  CRISPR gRNA sequence
atagtggccttgaataatct

SEQ ID NO: 812633 - DNA, 20 bp, Artificial
  CRISPR gRNA sequence
gaataatcttttgtatttct

SEQ ID NO: 812634 - DNA, 20 bp, Artificial
  CRISPR gRNA sequence
aataatcttttgtatttctg

SEQ ID NO: 812635 - DNA, 20 bp, Artificial
  CRISPR gRNA sequence
ttgtatttctgtgatatgag

SEQ ID NO: 812636 - DNA, 20 bp, Artificial
  CRISPR gRNA sequence
tgtatttctgtgatatgagt

SEQ ID NO: 812637 - DNA, 20 bp, Artificial
  CRISPR gRNA sequence
gtatttctgtgatatgagta

SEQ ID NO: 812638 - DNA, 20 bp, Artificial
  CRISPR gRNA sequence
tatttctgtgatatgagtag

SEQ ID NO: 812639 - DNA, 20 bp, Artificial
  CRISPR gRNA sequence
ctgtgatatgagtagtaata

SEQ ID NO: 812640 - DNA, 20 bp, Artificial
  CRISPR gRNA sequence
tgtgatatgagtagtaatat

SEQ ID NO: 812641 - DNA, 20 bp, Artificial
  CRISPR gRNA sequence
tgatatgagtagtaatatct

SEQ ID NO: 812642 - DNA, 20 bp, Artificial
  CRISPR gRNA sequence
catttcatttctaattgaga

SEQ ID NO: 812643 - DNA, 20 bp, Artificial
  CRISPR gRNA sequence
catttctaattgagattatt

SEQ ID NO: 812644 - DNA, 20 bp, Artificial
  CRISPR gRNA sequence
atttctaattgagattattt

SEQ ID NO: 812645 - DNA, 20 bp, Artificial
  CRISPR gRNA sequence
ctaattgagattatttggat

SEQ ID NO: 812646 - DNA, 20 bp, Artificial
  CRISPR gRNA sequence
taattgagattatttggatc

SEQ ID NO: 812647 - DNA, 20 bp, Artificial
  CRISPR gRNA sequence
attgagattatttggatctt

SEQ ID NO: 812648 - DNA, 20 bp, Artificial
  CRISPR gRNA sequence
agattatttggatcttctct

SEQ ID NO: 812649 - DNA, 20 bp, Artificial
  CRISPR gRNA sequence
tttggatcttctctcttctt

SEQ ID NO: 812650 - DNA, 20 bp, Artificial
  CRISPR gRNA sequence
ggatcttctctcttcttttc

SEQ ID NO: 812651 - DNA, 20 bp, Artificial
  CRISPR gRNA sequence
gatcttctctcttcttttct

SEQ ID NO: 812652 - DNA, 20 bp, Artificial
  CRISPR gRNA sequence
ctctcttcttttcttggtta

SEQ ID NO: 812653 - DNA, 20 bp, Artificial
  CRISPR gRNA sequence
tctcttcttttcttggttat

SEQ ID NO: 812654 - DNA, 20 bp, Artificial
  CRISPR gRNA sequence
tcttcttttcttggttatca

SEQ ID NO: 812655 - DNA, 20 bp, Artificial
  CRISPR gRNA sequence
ttcttttcttggttatcaat

SEQ ID NO: 812656 - DNA, 20 bp, Artificial
  CRISPR gRNA sequence
cttttcttggttatcaattt

SEQ ID NO: 812657 - DNA, 20 bp, Artificial
  CRISPR gRNA sequence
ttttcttggttatcaatttt

SEQ ID NO: 812658 - DNA, 20 bp, Artificial
  CRISPR gRNA sequence
ttcttggttatcaattttat

SEQ ID NO: 812659 - DNA, 20 bp, Artificial
  CRISPR gRNA sequence
tcttggttatcaattttatt

SEQ ID NO: 812660 - DNA, 20 bp, Artificial
  CRISPR gRNA sequence
cttggttatcaattttattt

SEQ ID NO: 812661 - DNA, 20 bp, Artificial
  CRISPR gRNA sequence
ttggttatcaattttattta

SEQ ID NO: 812662 - DNA, 20 bp, Artificial
  CRISPR gRNA sequence
ggttatcaattttatttatc

SEQ ID NO: 812663 - DNA, 20 bp, Artificial
  CRISPR gRNA sequence
gttatcaattttatttatct

SEQ ID NO: 812664 - DNA, 20 bp, Artificial
  CRISPR gRNA sequence
tcaattttatttatcttttc

SEQ ID NO: 812665 - DNA, 20 bp, Artificial
  CRISPR gRNA sequence
tatttatcttttcaaataac

SEQ ID NO: 812666 - DNA, 20 bp, Artificial
  CRISPR gRNA sequence
atttatcttttcaaataacc

SEQ ID NO: 812667 - DNA, 20 bp, Artificial
  CRISPR gRNA sequence
tttatcttttcaaataacca

SEQ ID NO: 812668 - DNA, 20 bp, Artificial
  CRISPR gRNA sequence
atcttttcaaataaccagat

SEQ ID NO: 812669 - DNA, 20 bp, Artificial
  CRISPR gRNA sequence
tcttttcaaataaccagatt

SEQ ID NO: 812670 - DNA, 20 bp, Artificial
  CRISPR gRNA sequence
ttcaaataaccagatttttg

SEQ ID NO: 812671 - DNA, 20 bp, Artificial
  CRISPR gRNA sequence
tcaaataaccagatttttgt

SEQ ID NO: 812672 - DNA, 20 bp, Artificial
  CRISPR gRNA sequence
caaataaccagatttttgtt

SEQ ID NO: 812673 - DNA, 20 bp, Artificial
  CRISPR gRNA sequence
aaataaccagatttttgttt

SEQ ID NO: 812674 - DNA, 20 bp, Artificial
  CRISPR gRNA sequence
ttgtttcatttctcttttgt

SEQ ID NO: 812675 - DNA, 20 bp, Artificial
  CRISPR gRNA sequence
tgtttcatttctcttttgta

SEQ ID NO: 812676 - DNA, 20 bp, Artificial
  CRISPR gRNA sequence
gtttcatttctcttttgtat

SEQ ID NO: 812677 - DNA, 20 bp, Artificial
  CRISPR gRNA sequence
tttcatttctcttttgtatt

SEQ ID NO: 812678 - DNA, 20 bp, Artificial
  CRISPR gRNA sequence
catttctcttttgtattttt

SEQ ID NO: 812679 - DNA, 20 bp, Artificial
  CRISPR gRNA sequence
atttctcttttgtatttttt

SEQ ID NO: 812680 - DNA, 20 bp, Artificial
  CRISPR gRNA sequence
ctcttttgtattttttttgt

SEQ ID NO: 812681 - DNA, 20 bp, Artificial
  CRISPR gRNA sequence
tcttttgtattttttttgtt

SEQ ID NO: 812682 - DNA, 20 bp, Artificial
  CRISPR gRNA sequence
ttttgtattttttttgtttc

SEQ ID NO: 812683 - DNA, 20 bp, Artificial
  CRISPR gRNA sequence
ttgtattttttttgtttcaa

SEQ ID NO: 812684 - DNA, 20 bp, Artificial
  CRISPR gRNA sequence
tgtattttttttgtttcaat

SEQ ID NO: 812685 - DNA, 20 bp, Artificial
  CRISPR gRNA sequence
gtattttttttgtttcaatt

SEQ ID NO: 812686 - DNA, 20 bp, Artificial
  CRISPR gRNA sequence
tattttttttgtttcaattt

SEQ ID NO: 812687 - DNA, 20 bp, Artificial
  CRISPR gRNA sequence
tttttgtttcaatttcattt

SEQ ID NO: 812688 - DNA, 20 bp, Artificial
  CRISPR gRNA sequence
ttttgtttcaatttcattta

SEQ ID NO: 812689 - DNA, 20 bp, Artificial
  CRISPR gRNA sequence
tttgtttcaatttcatttag

SEQ ID NO: 812690 - DNA, 20 bp, Artificial
  CRISPR gRNA sequence
ttgtttcaatttcatttagt

SEQ ID NO: 812691 - DNA, 20 bp, Artificial
  CRISPR gRNA sequence
tgtttcaatttcatttagtt

SEQ ID NO: 812692 - DNA, 20 bp, Artificial
  CRISPR gRNA sequence
gtttcaatttcatttagttc

SEQ ID NO: 812693 - DNA, 20 bp, Artificial
  CRISPR gRNA sequence
tttcaatttcatttagttct

SEQ ID NO: 812694 - DNA, 20 bp, Artificial
  CRISPR gRNA sequence
caatttcatttagttctgcc

SEQ ID NO: 812695 - DNA, 20 bp, Artificial
  CRISPR gRNA sequence
aatttcatttagttctgccc

SEQ ID NO: 812696 - DNA, 20 bp, Artificial
  CRISPR gRNA sequence
catttagttctgccctgatc

SEQ ID NO: 812697 - DNA, 20 bp, Artificial
  CRISPR gRNA sequence
atttagttctgccctgatct

SEQ ID NO: 812698 - DNA, 20 bp, Artificial
  CRISPR gRNA sequence
agttctgccctgatctttgt

SEQ ID NO: 812699 - DNA, 20 bp, Artificial
  CRISPR gRNA sequence
gttctgccctgatctttgta

SEQ ID NO: 812700 - DNA, 20 bp, Artificial
  CRISPR gRNA sequence
tgccctgatctttgtaattt

SEQ ID NO: 812701 - DNA, 20 bp, Artificial
  CRISPR gRNA sequence
ccctgatctttgtaatttct

SEQ ID NO: 812702 - DNA, 20 bp, Artificial
  CRISPR gRNA sequence
atctttgtaatttcttttct

SEQ ID NO: 812703 - DNA, 20 bp, Artificial
  CRISPR gRNA sequence
tgtaatttcttttcttctgc

SEQ ID NO: 812704 - DNA, 20 bp, Artificial
  CRISPR gRNA sequence
gtaatttcttttcttctgct

SEQ ID NO: 812705 - DNA, 20 bp, Artificial
  CRISPR gRNA sequence
taatttcttttcttctgctg

SEQ ID NO: 812706 - DNA, 20 bp, Artificial
  CRISPR gRNA sequence
cttttcttctgctgggtttg

SEQ ID NO: 812707 - DNA, 20 bp, Artificial
  CRISPR gRNA sequence
ttttcttctgctgggtttgg

SEQ ID NO: 812708 - DNA, 20 bp, Artificial
  CRISPR gRNA sequence
ttcttctgctgggtttgggt

SEQ ID NO: 812709 - DNA, 20 bp, Artificial
  CRISPR gRNA sequence
tcttctgctgggtttgggtt

SEQ ID NO: 812710 - DNA, 20 bp, Artificial
  CRISPR gRNA sequence
cttctgctgggtttgggttt

SEQ ID NO: 812711 - DNA, 20 bp, Artificial
  CRISPR gRNA sequence
ttctgctgggtttgggtttg

SEQ ID NO: 812712 - DNA, 20 bp, Artificial
  CRISPR gRNA sequence
ctgctgggtttgggtttgga

SEQ ID NO: 812713 - DNA, 20 bp, Artificial
  CRISPR gRNA sequence
tgctgggtttgggtttggat

SEQ ID NO: 812714 - DNA, 20 bp, Artificial
  CRISPR gRNA sequence
ctgggtttgggtttggattg

SEQ ID NO: 812715 - DNA, 20 bp, Artificial
  CRISPR gRNA sequence
ggtttgggtttggattgttc

SEQ ID NO: 812716 - DNA, 20 bp, Artificial
  CRISPR gRNA sequence
gggtttggattgttcttgtt

SEQ ID NO: 812717 - DNA, 20 bp, Artificial
  CRISPR gRNA sequence
ggtttggattgttcttgttt

SEQ ID NO: 812718 - DNA, 20 bp, Artificial
  CRISPR gRNA sequence
ggattgttcttgtttctcca

SEQ ID NO: 812719 - DNA, 20 bp, Artificial
  CRISPR gRNA sequence
gattgttcttgtttctccag

SEQ ID NO: 812720 - DNA, 20 bp, Artificial
  CRISPR gRNA sequence
ttcttgtttctccagctcca

SEQ ID NO: 812721 - DNA, 20 bp, Artificial
  CRISPR gRNA sequence
ttgtttctccagctccagga

SEQ ID NO: 812722 - DNA, 20 bp, Artificial
  CRISPR gRNA sequence
gtttctccagctccaggagg

SEQ ID NO: 812723 - DNA, 20 bp, Artificial
  CRISPR gRNA sequence
tttctccagctccaggaggt

SEQ ID NO: 812724 - DNA, 20 bp, Artificial
  CRISPR gRNA sequence
ctccagctccaggaggtgtg

SEQ ID NO: 812725 - DNA, 20 bp, Artificial
  CRISPR gRNA sequence
tccagctccaggaggtgtga

SEQ ID NO: 812726 - DNA, 20 bp, Artificial
  CRISPR gRNA sequence
cagctccaggaggtgtgacc

SEQ ID NO: 812727 - DNA, 20 bp, Artificial
  CRISPR gRNA sequence
caggaggtgtgaccttagat

SEQ ID NO: 812728 - DNA, 20 bp, Artificial
  CRISPR gRNA sequence
agattgcctatttgtgctct

SEQ ID NO: 812729 - DNA, 20 bp, Artificial
  CRISPR gRNA sequence
gattgcctatttgtgctctt

SEQ ID NO: 812730 - DNA, 20 bp, Artificial
  CRISPR gRNA sequence
cctatttgtgctctttcaga

SEQ ID NO: 812731 - DNA, 20 bp, Artificial
  CRISPR gRNA sequence
tttgtgctctttcagacttt

SEQ ID NO: 812732 - DNA, 20 bp, Artificial
  CRISPR gRNA sequence
gtgctctttcagactttttg

SEQ ID NO: 812733 - DNA, 20 bp, Artificial
  CRISPR gRNA sequence
tgctctttcagactttttga

SEQ ID NO: 812734 - DNA, 20 bp, Artificial
  CRISPR gRNA sequence
tttcagactttttgatgtag

SEQ ID NO: 812735 - DNA, 20 bp, Artificial
  CRISPR gRNA sequence
tcagactttttgatgtaggc

SEQ ID NO: 812736 - DNA, 20 bp, Artificial
  CRISPR gRNA sequence
cagactttttgatgtaggca

SEQ ID NO: 812737 - DNA, 20 bp, Artificial
  CRISPR gRNA sequence
agactttttgatgtaggcat

SEQ ID NO: 812738 - DNA, 20 bp, Artificial
  CRISPR gRNA sequence
tttgatgtaggcatttaatg

SEQ ID NO: 812739 - DNA, 20 bp, Artificial
  CRISPR gRNA sequence
ttgatgtaggcatttaatgc

SEQ ID NO: 812740 - DNA, 20 bp, Artificial
  CRISPR gRNA sequence
tgatgtaggcatttaatgct

SEQ ID NO: 812741 - DNA, 20 bp, Artificial
  CRISPR gRNA sequence
gatgtaggcatttaatgcta

SEQ ID NO: 812742 - DNA, 20 bp, Artificial
  CRISPR gRNA sequence
atgtaggcatttaatgctat

SEQ ID NO: 812743 - DNA, 20 bp, Artificial
  CRISPR gRNA sequence
aatgctatgaatgtttctct

SEQ ID NO: 812744 - DNA, 20 bp, Artificial
  CRISPR gRNA sequence
atgctatgaatgtttctctt

SEQ ID NO: 812745 - DNA, 20 bp, Artificial
  CRISPR gRNA sequence
tgaatgtttctcttagcact

SEQ ID NO: 812746 - DNA, 20 bp, Artificial
  CRISPR gRNA sequence
ctcttagcactgcttttgct

SEQ ID NO: 812747 - DNA, 20 bp, Artificial
  CRISPR gRNA sequence
tcttagcactgcttttgctg

SEQ ID NO: 812748 - DNA, 20 bp, Artificial
  CRISPR gRNA sequence
ttagcactgcttttgctgta

SEQ ID NO: 812749 - DNA, 20 bp, Artificial
  CRISPR gRNA sequence
agcactgcttttgctgtatc

SEQ ID NO: 812750 - DNA, 20 bp, Artificial
  CRISPR gRNA sequence
gcactgcttttgctgtatcc

SEQ ID NO: 812751 - DNA, 20 bp, Artificial
  CRISPR gRNA sequence
cttttgctgtatcccagagt

SEQ ID NO: 812752 - DNA, 20 bp, Artificial
  CRISPR gRNA sequence
ttgctgtatcccagagtttt

SEQ ID NO: 812753 - DNA, 20 bp, Artificial
  CRISPR gRNA sequence
tgctgtatcccagagttttg

SEQ ID NO: 812754 - DNA, 20 bp, Artificial
  CRISPR gRNA sequence
gctgtatcccagagttttga

SEQ ID NO: 812755 - DNA, 20 bp, Artificial
  CRISPR gRNA sequence
ctgtatcccagagttttgat

SEQ ID NO: 812756 - DNA, 20 bp, Artificial
  CRISPR gRNA sequence
tatcccagagttttgatagg

SEQ ID NO: 812757 - DNA, 20 bp, Artificial
  CRISPR gRNA sequence
tgataggttgtgtcactatt

SEQ ID NO: 812758 - DNA, 20 bp, Artificial
  CRISPR gRNA sequence
gataggttgtgtcactatta

SEQ ID NO: 812759 - DNA, 20 bp, Artificial
  CRISPR gRNA sequence
ataggttgtgtcactattat

SEQ ID NO: 812760 - DNA, 20 bp, Artificial
  CRISPR gRNA sequence
tgtcactattatcgttcagt

SEQ ID NO: 812761 - DNA, 20 bp, Artificial
  CRISPR gRNA sequence
ttatcgttcagttcaaagag

SEQ ID NO: 812762 - DNA, 20 bp, Artificial
  CRISPR gRNA sequence
tcgttcagttcaaagagttt

SEQ ID NO: 812763 - DNA, 20 bp, Artificial
  CRISPR gRNA sequence
agttcaaagagtttttaaat

SEQ ID NO: 812764 - DNA, 20 bp, Artificial
  CRISPR gRNA sequence
aaagagtttttaaatttcta

SEQ ID NO: 812765 - DNA, 20 bp, Artificial
  CRISPR gRNA sequence
ttaaatttctatcttgattt

SEQ ID NO: 812766 - DNA, 20 bp, Artificial
  CRISPR gRNA sequence
taaatttctatcttgatttc

SEQ ID NO: 812767 - DNA, 20 bp, Artificial
  CRISPR gRNA sequence
aaatttctatcttgatttca

SEQ ID NO: 812768 - DNA, 20 bp, Artificial
  CRISPR gRNA sequence
aatttctatcttgatttcat

SEQ ID NO: 812769 - DNA, 20 bp, Artificial
  CRISPR gRNA sequence
ctatcttgatttcattgttc

SEQ ID NO: 812770 - DNA, 20 bp, Artificial
  CRISPR gRNA sequence
tatcttgatttcattgttca

SEQ ID NO: 812771 - DNA, 20 bp, Artificial
  CRISPR gRNA sequence
tcttgatttcattgttcacc

SEQ ID NO: 812772 - DNA, 20 bp, Artificial
  CRISPR gRNA sequence
gatttcattgttcacccaat

SEQ ID NO: 812773 - DNA, 20 bp, Artificial
  CRISPR gRNA sequence
atttcattgttcacccaatg

SEQ ID NO: 812774 - DNA, 20 bp, Artificial
  CRISPR gRNA sequence
cattgttcacccaatgatca

SEQ ID NO: 812775 - DNA, 20 bp, Artificial
  CRISPR gRNA sequence
attgttcacccaatgatcac

SEQ ID NO: 812776 - DNA, 20 bp, Artificial
  CRISPR gRNA sequence
ttcacccaatgatcactcat

SEQ ID NO: 812777 - DNA, 20 bp, Artificial
  CRISPR gRNA sequence
acccaatgatcactcattat

SEQ ID NO: 812778 - DNA, 20 bp, Artificial
  CRISPR gRNA sequence
attatttaacttccatgtaa

SEQ ID NO: 812779 - DNA, 20 bp, Artificial
  CRISPR gRNA sequence
tttaacttccatgtaattgc

SEQ ID NO: 812780 - DNA, 20 bp, Artificial
  CRISPR gRNA sequence
aacttccatgtaattgcatg

SEQ ID NO: 812781 - DNA, 20 bp, Artificial
  CRISPR gRNA sequence
acttccatgtaattgcatgg

SEQ ID NO: 812782 - DNA, 20 bp, Artificial
  CRISPR gRNA sequence
ccatgtaattgcatggtttt

SEQ ID NO: 812783 - DNA, 20 bp, Artificial
  CRISPR gRNA sequence
catgtaattgcatggttttg

SEQ ID NO: 812784 - DNA, 20 bp, Artificial
  CRISPR gRNA sequence
catggttttgaaggttcctt

SEQ ID NO: 812785 - DNA, 20 bp, Artificial
  CRISPR gRNA sequence
tgaaggttccttttggagtt

SEQ ID NO: 812786 - DNA, 20 bp, Artificial
  CRISPR gRNA sequence
gaaggttccttttggagttt

SEQ ID NO: 812787 - DNA, 20 bp, Artificial
  CRISPR gRNA sequence
aaggttccttttggagttta

SEQ ID NO: 812788 - DNA, 20 bp, Artificial
  CRISPR gRNA sequence
cttttggagtttatttccag

SEQ ID NO: 812789 - DNA, 20 bp, Artificial
  CRISPR gRNA sequence
ttggagtttatttccagttt

SEQ ID NO: 812790 - DNA, 20 bp, Artificial
  CRISPR gRNA sequence
tggagtttatttccagtttt

SEQ ID NO: 812791 - DNA, 20 bp, Artificial
  CRISPR gRNA sequence
ggagtttatttccagtttta

SEQ ID NO: 812792 - DNA, 20 bp, Artificial
  CRISPR gRNA sequence
gagtttatttccagttttac

SEQ ID NO: 812793 - DNA, 20 bp, Artificial
  CRISPR gRNA sequence
atttccagttttactccact

SEQ ID NO: 812794 - DNA, 20 bp, Artificial
  CRISPR gRNA sequence
tttccagttttactccactg

SEQ ID NO: 812795 - DNA, 20 bp, Artificial
  CRISPR gRNA sequence
ccagttttactccactgtga

SEQ ID NO: 812796 - DNA, 20 bp, Artificial
  CRISPR gRNA sequence
cagttttactccactgtgat

SEQ ID NO: 812797 - DNA, 20 bp, Artificial
  CRISPR gRNA sequence
tactccactgtgatctaaga

SEQ ID NO: 812798 - DNA, 20 bp, Artificial
  CRISPR gRNA sequence
actccactgtgatctaagag

SEQ ID NO: 812799 - DNA, 20 bp, Artificial
  CRISPR gRNA sequence
ctccactgtgatctaagaga

SEQ ID NO: 812800 - DNA, 20 bp, Artificial
  CRISPR gRNA sequence
cactgtgatctaagagagta

SEQ ID NO: 812801 - DNA, 20 bp, Artificial
  CRISPR gRNA sequence
tgatctaagagagtacttga

SEQ ID NO: 812802 - DNA, 20 bp, Artificial
  CRISPR gRNA sequence
agagagtacttgatataatt

SEQ ID NO: 812803 - DNA, 20 bp, Artificial
  CRISPR gRNA sequence
gatataattttgattttctt

SEQ ID NO: 812804 - DNA, 20 bp, Artificial
  CRISPR gRNA sequence
atataattttgattttctta

SEQ ID NO: 812805 - DNA, 20 bp, Artificial
  CRISPR gRNA sequence
tgattttcttaaatttatgg

SEQ ID NO: 812806 - DNA, 20 bp, Artificial
  CRISPR gRNA sequence
gattttcttaaatttatgga

SEQ ID NO: 812807 - DNA, 20 bp, Artificial
  CRISPR gRNA sequence
attttcttaaatttatggag

SEQ ID NO: 812808 - DNA, 20 bp, Artificial
  CRISPR gRNA sequence
tcttaaatttatggagactt

SEQ ID NO: 812809 - DNA, 20 bp, Artificial
  CRISPR gRNA sequence
cttaaatttatggagacttg

SEQ ID NO: 812810 - DNA, 20 bp, Artificial
  CRISPR gRNA sequence
ttaaatttatggagacttgt

SEQ ID NO: 812811 - DNA, 20 bp, Artificial
  CRISPR gRNA sequence
aaatttatggagacttgttt

SEQ ID NO: 812812 - DNA, 20 bp, Artificial
  CRISPR gRNA sequence
aatttatggagacttgtttt

SEQ ID NO: 812813 - DNA, 20 bp, Artificial
  CRISPR gRNA sequence
atggagacttgttttgtggc

SEQ ID NO: 812814 - DNA, 20 bp, Artificial
  CRISPR gRNA sequence
tggagacttgttttgtggcc

SEQ ID NO: 812815 - DNA, 20 bp, Artificial
  CRISPR gRNA sequence
gttttgtggcctactatata

SEQ ID NO: 812816 - DNA, 20 bp, Artificial
  CRISPR gRNA sequence
ttttgtggcctactatatag

SEQ ID NO: 812817 - DNA, 20 bp, Artificial
  CRISPR gRNA sequence
tgtggcctactatatagtct

SEQ ID NO: 812818 - DNA, 20 bp, Artificial
  CRISPR gRNA sequence
gtggcctactatatagtcta

SEQ ID NO: 812819 - DNA, 20 bp, Artificial
  CRISPR gRNA sequence
tggcctactatatagtctat

SEQ ID NO: 812820 - DNA, 20 bp, Artificial
  CRISPR gRNA sequence
ctatatagtctatcttggag

SEQ ID NO: 812821 - DNA, 20 bp, Artificial
  CRISPR gRNA sequence
tatagtctatcttggagaat

SEQ ID NO: 812822 - DNA, 20 bp, Artificial
  CRISPR gRNA sequence
tcttggagaatgttccatat

SEQ ID NO: 812823 - DNA, 20 bp, Artificial
  CRISPR gRNA sequence
ggagaatgttccatatgctg

SEQ ID NO: 812824 - DNA, 20 bp, Artificial
  CRISPR gRNA sequence
gagaatgttccatatgctga

SEQ ID NO: 812825 - DNA, 20 bp, Artificial
  CRISPR gRNA sequence
catatgctgatgaatagaat

SEQ ID NO: 812826 - DNA, 20 bp, Artificial
  CRISPR gRNA sequence
atgaatagaatgtatattct

SEQ ID NO: 812827 - DNA, 20 bp, Artificial
  CRISPR gRNA sequence
tgcgattgttgggtagaatg

SEQ ID NO: 812828 - DNA, 20 bp, Artificial
  CRISPR gRNA sequence
cgattgttgggtagaatgtt

SEQ ID NO: 812829 - DNA, 20 bp, Artificial
  CRISPR gRNA sequence
ttgggtagaatgttctgtaa

SEQ ID NO: 812830 - DNA, 20 bp, Artificial
  CRISPR gRNA sequence
ggtagaatgttctgtaaata

SEQ ID NO: 812831 - DNA, 20 bp, Artificial
  CRISPR gRNA sequence
tgtaaatatctgttaagtct

SEQ ID NO: 812832 - DNA, 20 bp, Artificial
  CRISPR gRNA sequence
taaatatctgttaagtctat

SEQ ID NO: 812833 - DNA, 20 bp, Artificial
  CRISPR gRNA sequence
ttaagtctatttgtggtagg

SEQ ID NO: 812834 - DNA, 20 bp, Artificial
  CRISPR gRNA sequence
agtctatttgtggtagggca

SEQ ID NO: 812835 - DNA, 20 bp, Artificial
  CRISPR gRNA sequence
tttgtggtagggcatagttt

SEQ ID NO: 812836 - DNA, 20 bp, Artificial
  CRISPR gRNA sequence
gtggtagggcatagtttaaa

SEQ ID NO: 812837 - DNA, 20 bp, Artificial
  CRISPR gRNA sequence
tggtagggcatagtttaaat

SEQ ID NO: 812838 - DNA, 20 bp, Artificial
  CRISPR gRNA sequence
aaattcattgtttctggttt

SEQ ID NO: 812839 - DNA, 20 bp, Artificial
  CRISPR gRNA sequence
aattcattgtttctggtttg

SEQ ID NO: 812840 - DNA, 20 bp, Artificial
  CRISPR gRNA sequence
attgtttctggtttgaagta

SEQ ID NO: 812841 - DNA, 20 bp, Artificial
  CRISPR gRNA sequence
tttctggtttgaagtacttc

SEQ ID NO: 812842 - DNA, 20 bp, Artificial
  CRISPR gRNA sequence
ctggtttgaagtacttctgt

SEQ ID NO: 812843 - DNA, 20 bp, Artificial
  CRISPR gRNA sequence
tggtttgaagtacttctgtc

SEQ ID NO: 812844 - DNA, 20 bp, Artificial
  CRISPR gRNA sequence
gtttgaagtacttctgtcag

SEQ ID NO: 812845 - DNA, 20 bp, Artificial
  CRISPR gRNA sequence
gaagtacttctgtcagcttc

SEQ ID NO: 812846 - DNA, 20 bp, Artificial
  CRISPR gRNA sequence
aagtacttctgtcagcttca

SEQ ID NO: 812847 - DNA, 20 bp, Artificial
  CRISPR gRNA sequence
ctgtcagcttcagcccattc

SEQ ID NO: 812848 - DNA, 20 bp, Artificial
  CRISPR gRNA sequence
tgtcagcttcagcccattcc

SEQ ID NO: 812849 - DNA, 20 bp, Artificial
  CRISPR gRNA sequence
tcagcttcagcccattcctg

SEQ ID NO: 812850 - DNA, 20 bp, Artificial
  CRISPR gRNA sequence
cagcccattcctggtgttgg

SEQ ID NO: 812851 - DNA, 20 bp, Artificial
  CRISPR gRNA sequence
agcccattcctggtgttggc

SEQ ID NO: 812852 - DNA, 20 bp, Artificial
  CRISPR gRNA sequence
ctggtgttggctcttcccat

SEQ ID NO: 812853 - DNA, 20 bp, Artificial
  CRISPR gRNA sequence
gtgttggctcttcccatccc

SEQ ID NO: 812854 - DNA, 20 bp, Artificial
  CRISPR gRNA sequence
gctcttcccatccccctgcc

SEQ ID NO: 812855 - DNA, 20 bp, Artificial
  CRISPR gRNA sequence
ttcccatccccctgccctgc

SEQ ID NO: 812856 - DNA, 20 bp, Artificial
  CRISPR gRNA sequence
cccatccccctgccctgccc

SEQ ID NO: 812857 - DNA, 20 bp, Artificial
  CRISPR gRNA sequence
ccatccccctgccctgccca

SEQ ID NO: 812858 - DNA, 20 bp, Artificial
  CRISPR gRNA sequence
ccctgcccaggccttcagga

SEQ ID NO: 812859 - DNA, 20 bp, Artificial
  CRISPR gRNA sequence
cccaggccttcaggatggtt

SEQ ID NO: 812860 - DNA, 20 bp, Artificial
  CRISPR gRNA sequence
caggatggtttggctcttgg

SEQ ID NO: 812861 - DNA, 20 bp, Artificial
  CRISPR gRNA sequence
aggatggtttggctcttggt

SEQ ID NO: 812862 - DNA, 20 bp, Artificial
  CRISPR gRNA sequence
ggctcttggtgttcttgttt

SEQ ID NO: 812863 - DNA, 20 bp, Artificial
  CRISPR gRNA sequence
gctcttggtgttcttgtttt

SEQ ID NO: 812864 - DNA, 20 bp, Artificial
  CRISPR gRNA sequence
ttggtgttcttgtttttagt

SEQ ID NO: 812865 - DNA, 20 bp, Artificial
  CRISPR gRNA sequence
ggtgttcttgtttttagtgc

SEQ ID NO: 812866 - DNA, 20 bp, Artificial
  CRISPR gRNA sequence
gtgttcttgtttttagtgcc

SEQ ID NO: 812867 - DNA, 20 bp, Artificial
  CRISPR gRNA sequence
ttgtttttagtgcctcctct

SEQ ID NO: 812868 - DNA, 20 bp, Artificial
  CRISPR gRNA sequence
gtttttagtgcctcctctgc

SEQ ID NO: 812869 - DNA, 20 bp, Artificial
  CRISPR gRNA sequence
tttttagtgcctcctctgca

SEQ ID NO: 812870 - DNA, 20 bp, Artificial
  CRISPR gRNA sequence
ttagtgcctcctctgcaacc

SEQ ID NO: 812871 - DNA, 20 bp, Artificial
  CRISPR gRNA sequence
tagtgcctcctctgcaaccc

SEQ ID NO: 812872 - DNA, 20 bp, Artificial
  CRISPR gRNA sequence
agtgcctcctctgcaaccct

SEQ ID NO: 812873 - DNA, 20 bp, Artificial
  CRISPR gRNA sequence
gtgcctcctctgcaaccctg

SEQ ID NO: 812874 - DNA, 20 bp, Artificial
  CRISPR gRNA sequence
ctctgcaaccctgtctggaa

SEQ ID NO: 812875 - DNA, 20 bp, Artificial
  CRISPR gRNA sequence
tgcaaccctgtctggaaacc

SEQ ID NO: 812876 - DNA, 20 bp, Artificial
  CRISPR gRNA sequence
caaccctgtctggaaacctt

SEQ ID NO: 812877 - DNA, 20 bp, Artificial
  CRISPR gRNA sequence
tctggaaacctttgcacaga

SEQ ID NO: 812878 - DNA, 20 bp, Artificial
  CRISPR gRNA sequence
gaaacctttgcacagaccag

SEQ ID NO: 812879 - DNA, 20 bp, Artificial
  CRISPR gRNA sequence
tgcacagaccagttctcaac

SEQ ID NO: 812880 - DNA, 20 bp, Artificial
  CRISPR gRNA sequence
gcacagaccagttctcaacc

SEQ ID NO: 812881 - DNA, 20 bp, Artificial
  CRISPR gRNA sequence
cacagaccagttctcaaccc

SEQ ID NO: 812882 - DNA, 20 bp, Artificial
  CRISPR gRNA sequence
tcaaccccagctcctctgag

SEQ ID NO: 812883 - DNA, 20 bp, Artificial
  CRISPR gRNA sequence
aaccccagctcctctgagag

SEQ ID NO: 812884 - DNA, 20 bp, Artificial
  CRISPR gRNA sequence
ctctgagagacccctgggct

SEQ ID NO: 812885 - DNA, 20 bp, Artificial
  CRISPR gRNA sequence
tgagagacccctgggctcct

SEQ ID NO: 812886 - DNA, 20 bp, Artificial
  CRISPR gRNA sequence
agagacccctgggctcctgg

SEQ ID NO: 812887 - DNA, 20 bp, Artificial
  CRISPR gRNA sequence
ggctcctggggcctctctgt

SEQ ID NO: 812888 - DNA, 20 bp, Artificial
  CRISPR gRNA sequence
ctggggcctctctgttcttt

SEQ ID NO: 812889 - DNA, 20 bp, Artificial
  CRISPR gRNA sequence
gggcctctctgttctttggc

SEQ ID NO: 812890 - DNA, 20 bp, Artificial
  CRISPR gRNA sequence
tctgttctttggccatgctc

SEQ ID NO: 812891 - DNA, 20 bp, Artificial
  CRISPR gRNA sequence
tgttctttggccatgctccc

SEQ ID NO: 812892 - DNA, 20 bp, Artificial
  CRISPR gRNA sequence
ttctttggccatgctcccgc

SEQ ID NO: 812893 - DNA, 20 bp, Artificial
  CRISPR gRNA sequence
tttggccatgctcccgcccc

SEQ ID NO: 812894 - DNA, 20 bp, Artificial
  CRISPR gRNA sequence
tggccatgctcccgcccctt

SEQ ID NO: 812895 - DNA, 20 bp, Artificial
  CRISPR gRNA sequence
ggccatgctcccgccccttc

SEQ ID NO: 812896 - DNA, 20 bp, Artificial
  CRISPR gRNA sequence
gccatgctcccgccccttcc

SEQ ID NO: 812897 - DNA, 20 bp, Artificial
  CRISPR gRNA sequence
ccgccccttcctcagatgga

SEQ ID NO: 812898 - DNA, 20 bp, Artificial
  CRISPR gRNA sequence
cctcagatggattgccccca

SEQ ID NO: 812899 - DNA, 20 bp, Artificial
  CRISPR gRNA sequence
ctcagatggattgcccccag

SEQ ID NO: 812900 - DNA, 20 bp, Artificial
  CRISPR gRNA sequence
agatggattgcccccagaaa

SEQ ID NO: 812901 - DNA, 20 bp, Artificial
  CRISPR gRNA sequence
cccccagaaatgtaggtgcc

SEQ ID NO: 812902 - DNA, 20 bp, Artificial
  CRISPR gRNA sequence
gcttttcagaaaccacagtc

SEQ ID NO: 812903 - DNA, 20 bp, Artificial
  CRISPR gRNA sequence
ttcagaaaccacagtccttt

SEQ ID NO: 812904 - DNA, 20 bp, Artificial
  CRISPR gRNA sequence
tcagaaaccacagtccttta

SEQ ID NO: 812905 - DNA, 20 bp, Artificial
  CRISPR gRNA sequence
cagaaaccacagtcctttat

SEQ ID NO: 812906 - DNA, 20 bp, Artificial
  CRISPR gRNA sequence
agaaaccacagtcctttatc

SEQ ID NO: 812907 - DNA, 20 bp, Artificial
  CRISPR gRNA sequence
tatcactgtctcttccagaa

SEQ ID NO: 812908 - DNA, 20 bp, Artificial
  CRISPR gRNA sequence
atcactgtctcttccagaat

SEQ ID NO: 812909 - DNA, 20 bp, Artificial
  CRISPR gRNA sequence
tcactgtctcttccagaatc

SEQ ID NO: 812910 - DNA, 20 bp, Artificial
  CRISPR gRNA sequence
tctcttccagaatctccggt

SEQ ID NO: 812911 - DNA, 20 bp, Artificial
  CRISPR gRNA sequence
ttccagaatctccggtcatt

SEQ ID NO: 812912 - DNA, 20 bp, Artificial
  CRISPR gRNA sequence
ccagaatctccggtcattcc

SEQ ID NO: 812913 - DNA, 20 bp, Artificial
  CRISPR gRNA sequence
cagaatctccggtcattcca

SEQ ID NO: 812914 - DNA, 20 bp, Artificial
  CRISPR gRNA sequence
cggtcattccacctcataat

SEQ ID NO: 812915 - DNA, 20 bp, Artificial
  CRISPR gRNA sequence
cacctcataatttgttctgt

SEQ ID NO: 812916 - DNA, 20 bp, Artificial
  CRISPR gRNA sequence
ataatttgttctgtcctttt

SEQ ID NO: 812917 - DNA, 20 bp, Artificial
  CRISPR gRNA sequence
gttctgtccttttgaaatta

SEQ ID NO: 812918 - DNA, 20 bp, Artificial
  CRISPR gRNA sequence
ttctgtccttttgaaattaa

SEQ ID NO: 812919 - DNA, 20 bp, Artificial
  CRISPR gRNA sequence
tgtccttttgaaattaactc

SEQ ID NO: 812920 - DNA, 20 bp, Artificial
  CRISPR gRNA sequence
tccttttgaaattaactctt

SEQ ID NO: 812921 - DNA, 20 bp, Artificial
  CRISPR gRNA sequence
ttgaaattaactcttttcat

SEQ ID NO: 812922 - DNA, 20 bp, Artificial
  CRISPR gRNA sequence
tgaaattaactcttttcatt

SEQ ID NO: 812923 - DNA, 20 bp, Artificial
  CRISPR gRNA sequence
gaaattaactcttttcatta

SEQ ID NO: 812924 - DNA, 20 bp, Artificial
  CRISPR gRNA sequence
aaattaactcttttcattat

SEQ ID NO: 812925 - DNA, 20 bp, Artificial
  CRISPR gRNA sequence
actcttttcattatatttga

SEQ ID NO: 812926 - DNA, 20 bp, Artificial
  CRISPR gRNA sequence
ttttcattatatttgataag

SEQ ID NO: 812927 - DNA, 20 bp, Artificial
  CRISPR gRNA sequence
ttcattatatttgataagaa

SEQ ID NO: 812928 - DNA, 20 bp, Artificial
  CRISPR gRNA sequence
tcattatatttgataagaat

SEQ ID NO: 812929 - DNA, 20 bp, Artificial
  CRISPR gRNA sequence
cattatatttgataagaatt

SEQ ID NO: 812930 - DNA, 20 bp, Artificial
  CRISPR gRNA sequence
attatatttgataagaattt

SEQ ID NO: 812931 - DNA, 20 bp, Artificial
  CRISPR gRNA sequence
tatttgataagaatttctgc

SEQ ID NO: 812932 - DNA, 20 bp, Artificial
  CRISPR gRNA sequence
gataagaatttctgcccaga

SEQ ID NO: 812933 - DNA, 20 bp, Artificial
  CRISPR gRNA sequence
ataagaatttctgcccagac

SEQ ID NO: 812934 - DNA, 20 bp, Artificial
  CRISPR gRNA sequence
ctgcccagacatcaacgaag

SEQ ID NO: 812935 - DNA, 20 bp, Artificial
  CRISPR gRNA sequence
tgcccagacatcaacgaagg

SEQ ID NO: 812936 - DNA, 20 bp, Artificial
  CRISPR gRNA sequence
cccagacatcaacgaaggtg

SEQ ID NO: 812937 - DNA, 20 bp, Artificial
  CRISPR gRNA sequence
taaacaaacccattttcaag

SEQ ID NO: 812938 - DNA, 20 bp, Artificial
  CRISPR gRNA sequence
tcaagctttatgccatggat

SEQ ID NO: 812939 - DNA, 20 bp, Artificial
  CRISPR gRNA sequence
caagctttatgccatggatc

SEQ ID NO: 812940 - DNA, 20 bp, Artificial
  CRISPR gRNA sequence
aagctttatgccatggatca

SEQ ID NO: 812941 - DNA, 20 bp, Artificial
  CRISPR gRNA sequence
tatgccatggatcaggcact

SEQ ID NO: 812942 - DNA, 20 bp, Artificial
  CRISPR gRNA sequence
atgccatggatcaggcactt

SEQ ID NO: 812943 - DNA, 20 bp, Artificial
  CRISPR gRNA sequence
tgccatggatcaggcacttt

SEQ ID NO: 812944 - DNA, 20 bp, Artificial
  CRISPR gRNA sequence
taagataaaaacatgtcctt

SEQ ID NO: 812945 - DNA, 20 bp, Artificial
  CRISPR gRNA sequence
aagataaaaacatgtccttc

SEQ ID NO: 812946 - DNA, 20 bp, Artificial
  CRISPR gRNA sequence
agataaaaacatgtccttct

SEQ ID NO: 812947 - DNA, 20 bp, Artificial
  CRISPR gRNA sequence
cttctagtcctacttcattc

SEQ ID NO: 812948 - DNA, 20 bp, Artificial
  CRISPR gRNA sequence
ttctagtcctacttcattca

SEQ ID NO: 812949 - DNA, 20 bp, Artificial
  CRISPR gRNA sequence
ctagtcctacttcattcatg

SEQ ID NO: 812950 - DNA, 20 bp, Artificial
  CRISPR gRNA sequence
tagtcctacttcattcatgg

SEQ ID NO: 812951 - DNA, 20 bp, Artificial
  CRISPR gRNA sequence
gtcctacttcattcatggga

SEQ ID NO: 812952 - DNA, 20 bp, Artificial
  CRISPR gRNA sequence
cttcattcatgggaaccctc

SEQ ID NO: 812953 - DNA, 20 bp, Artificial
  CRISPR gRNA sequence
cattcatgggaaccctcatt

SEQ ID NO: 812954 - DNA, 20 bp, Artificial
  CRISPR gRNA sequence
attcatgggaaccctcattg

SEQ ID NO: 812955 - DNA, 20 bp, Artificial
  CRISPR gRNA sequence
atgggaaccctcattggggc

SEQ ID NO: 812956 - DNA, 20 bp, Artificial
  CRISPR gRNA sequence
attggggcctcagatctatc

SEQ ID NO: 812957 - DNA, 20 bp, Artificial
  CRISPR gRNA sequence
gggcctcagatctatcttgc

SEQ ID NO: 812958 - DNA, 20 bp, Artificial
  CRISPR gRNA sequence
agatctatcttgcttctttt

SEQ ID NO: 812959 - DNA, 20 bp, Artificial
  CRISPR gRNA sequence
tcttgcttcttttagagacc

SEQ ID NO: 812960 - DNA, 20 bp, Artificial
  CRISPR gRNA sequence
gcttcttttagagaccctgg

SEQ ID NO: 812961 - DNA, 20 bp, Artificial
  CRISPR gRNA sequence
cttcttttagagaccctgga

SEQ ID NO: 812962 - DNA, 20 bp, Artificial
  CRISPR gRNA sequence
cttttagagaccctggatca

SEQ ID NO: 812963 - DNA, 20 bp, Artificial
  CRISPR gRNA sequence
ttttagagaccctggatcag

SEQ ID NO: 812964 - DNA, 20 bp, Artificial
  CRISPR gRNA sequence
ttagagaccctggatcaggg

SEQ ID NO: 812965 - DNA, 20 bp, Artificial
  CRISPR gRNA sequence
tagagaccctggatcagggt

SEQ ID NO: 812966 - DNA, 20 bp, Artificial
  CRISPR gRNA sequence
agagaccctggatcagggta

SEQ ID NO: 812967 - DNA, 20 bp, Artificial
  CRISPR gRNA sequence
gagaccctggatcagggtag

SEQ ID NO: 812968 - DNA, 20 bp, Artificial
  CRISPR gRNA sequence
gatcagggtagcctactctt

SEQ ID NO: 812969 - DNA, 20 bp, Artificial
  CRISPR gRNA sequence
ctcttaggtgatggtccaac

SEQ ID NO: 812970 - DNA, 20 bp, Artificial
  CRISPR gRNA sequence
ttaggtgatggtccaacttt

SEQ ID NO: 812971 - DNA, 20 bp, Artificial
  CRISPR gRNA sequence
aggtgatggtccaacttttt

SEQ ID NO: 812972 - DNA, 20 bp, Artificial
  CRISPR gRNA sequence
ggtgatggtccaactttttt

SEQ ID NO: 812973 - DNA, 20 bp, Artificial
  CRISPR gRNA sequence
tttttttgcttgtattcctc

SEQ ID NO: 812974 - DNA, 20 bp, Artificial
  CRISPR gRNA sequence
ttttttgcttgtattcctcc

SEQ ID NO: 812975 - DNA, 20 bp, Artificial
  CRISPR gRNA sequence
tttttgcttgtattcctcct

SEQ ID NO: 812976 - DNA, 20 bp, Artificial
  CRISPR gRNA sequence
ttttgcttgtattcctccta

SEQ ID NO: 812977 - DNA, 20 bp, Artificial
  CRISPR gRNA sequence
tttgcttgtattcctcctaa

SEQ ID NO: 812978 - DNA, 20 bp, Artificial
  CRISPR gRNA sequence
ttgcttgtattcctcctaaa

SEQ ID NO: 812979 - DNA, 20 bp, Artificial
  CRISPR gRNA sequence
tgcttgtattcctcctaaaa

SEQ ID NO: 812980 - DNA, 20 bp, Artificial
  CRISPR gRNA sequence
gcttgtattcctcctaaaat

SEQ ID NO: 812981 - DNA, 20 bp, Artificial
  CRISPR gRNA sequence
cttgtattcctcctaaaata

SEQ ID NO: 812982 - DNA, 20 bp, Artificial
  CRISPR gRNA sequence
gtattcctcctaaaataagt

SEQ ID NO: 812983 - DNA, 20 bp, Artificial
  CRISPR gRNA sequence
tattcctcctaaaataagta

SEQ ID NO: 812984 - DNA, 20 bp, Artificial
  CRISPR gRNA sequence
ctcctaaaataagtatgatg

SEQ ID NO: 812985 - DNA, 20 bp, Artificial
  CRISPR gRNA sequence
ctaaaataagtatgatgcag

SEQ ID NO: 812986 - DNA, 20 bp, Artificial
  CRISPR gRNA sequence
aaataagtatgatgcagtat

SEQ ID NO: 812987 - DNA, 20 bp, Artificial
  CRISPR gRNA sequence
ttctcacctattaagttgat

SEQ ID NO: 812988 - DNA, 20 bp, Artificial
  CRISPR gRNA sequence
ctcacctattaagttgattc

SEQ ID NO: 812989 - DNA, 20 bp, Artificial
  CRISPR gRNA sequence
tcacctattaagttgattct

SEQ ID NO: 812990 - DNA, 20 bp, Artificial
  CRISPR gRNA sequence
acctattaagttgattctta

SEQ ID NO: 812991 - DNA, 20 bp, Artificial
  CRISPR gRNA sequence
ttaagttgattcttataatt

SEQ ID NO: 812992 - DNA, 20 bp, Artificial
  CRISPR gRNA sequence
agttgattcttataattttt

SEQ ID NO: 812993 - DNA, 20 bp, Artificial
  CRISPR gRNA sequence
attcttataatttttcataa

SEQ ID NO: 812994 - DNA, 20 bp, Artificial
  CRISPR gRNA sequence
ttataatttttcataagttt

SEQ ID NO: 812995 - DNA, 20 bp, Artificial
  CRISPR gRNA sequence
ataatttttcataagtttct

SEQ ID NO: 812996 - DNA, 20 bp, Artificial
  CRISPR gRNA sequence
taatttttcataagtttcta

SEQ ID NO: 812997 - DNA, 20 bp, Artificial
  CRISPR gRNA sequence
ttcataagtttctatactgg

SEQ ID NO: 812998 - DNA, 20 bp, Artificial
  CRISPR gRNA sequence
tcataagtttctatactgga

SEQ ID NO: 812999 - DNA, 20 bp, Artificial
  CRISPR gRNA sequence
cataagtttctatactggaa

SEQ ID NO: 813000 - DNA, 20 bp, Artificial
  CRISPR gRNA sequence
ataagtttctatactggaaa

SEQ ID NO: 813001 - DNA, 20 bp, Artificial
  CRISPR gRNA sequence
ctatactggaaaaacatata

SEQ ID NO: 813002 - DNA, 20 bp, Artificial
  CRISPR gRNA sequence
tatactggaaaaacatataa

SEQ ID NO: 813003 - DNA, 20 bp, Artificial
  CRISPR gRNA sequence
tactggaaaaacatataatg

SEQ ID NO: 813004 - DNA, 20 bp, Artificial
  CRISPR gRNA sequence
gaaaaacatataatgttcag

SEQ ID NO: 813005 - DNA, 20 bp, Artificial
  CRISPR gRNA sequence
agcatcttatgaattttttt

SEQ ID NO: 813006 - DNA, 20 bp, Artificial
  CRISPR gRNA sequence
atgaatttttttagtaaaac

SEQ ID NO: 813007 - DNA, 20 bp, Artificial
  CRISPR gRNA sequence
tgaatttttttagtaaaaca

SEQ ID NO: 813008 - DNA, 20 bp, Artificial
  CRISPR gRNA sequence
ttttagtaaaacaattattt

SEQ ID NO: 813009 - DNA, 20 bp, Artificial
  CRISPR gRNA sequence
tttagtaaaacaattatttt

SEQ ID NO: 813010 - DNA, 20 bp, Artificial
  CRISPR gRNA sequence
ttagtaaaacaattatttta

SEQ ID NO: 813011 - DNA, 20 bp, Artificial
  CRISPR gRNA sequence
tagtaaaacaattattttac

SEQ ID NO: 813012 - DNA, 20 bp, Artificial
  CRISPR gRNA sequence
agtaaaacaattattttact

SEQ ID NO: 813013 - DNA, 20 bp, Artificial
  CRISPR gRNA sequence
gtaaaacaattattttactc

SEQ ID NO: 813014 - DNA, 20 bp, Artificial
  CRISPR gRNA sequence
ttttactcttacatatgtat

SEQ ID NO: 813015 - DNA, 20 bp, Artificial
  CRISPR gRNA sequence
tactcttacatatgtatcca

SEQ ID NO: 813016 - DNA, 20 bp, Artificial
  CRISPR gRNA sequence
actcttacatatgtatccaa

SEQ ID NO: 813017 - DNA, 20 bp, Artificial
  CRISPR gRNA sequence
ctcttacatatgtatccaaa

SEQ ID NO: 813018 - DNA, 20 bp, Artificial
  CRISPR gRNA sequence
ttacatatgtatccaaaggt

SEQ ID NO: 813019 - DNA, 20 bp, Artificial
  CRISPR gRNA sequence
acatatgtatccaaaggtga

SEQ ID NO: 813020 - DNA, 20 bp, Artificial
  CRISPR gRNA sequence
catatgtatccaaaggtgac

SEQ ID NO: 813021 - DNA, 20 bp, Artificial
  CRISPR gRNA sequence
aatataaaagaagttatctt

SEQ ID NO: 813022 - DNA, 20 bp, Artificial
  CRISPR gRNA sequence
tcttttatatacaacattat

SEQ ID NO: 813023 - DNA, 20 bp, Artificial
  CRISPR gRNA sequence
ttatatacaacattatcctt

SEQ ID NO: 813024 - DNA, 20 bp, Artificial
  CRISPR gRNA sequence
tatatacaacattatccttg

SEQ ID NO: 813025 - DNA, 20 bp, Artificial
  CRISPR gRNA sequence
atatacaacattatccttga

SEQ ID NO: 813026 - DNA, 20 bp, Artificial
  CRISPR gRNA sequence
tatacaacattatccttgaa

SEQ ID NO: 813027 - DNA, 20 bp, Artificial
  CRISPR gRNA sequence
tccttgaaaaatacatataa

SEQ ID NO: 813028 - DNA, 20 bp, Artificial
  CRISPR gRNA sequence
gaaaaatacatataaatatt

SEQ ID NO: 813029 - DNA, 20 bp, Artificial
  CRISPR gRNA sequence
aaaaatacatataaatattt

SEQ ID NO: 813030 - DNA, 20 bp, Artificial
  CRISPR gRNA sequence
aacaacagtatatagcttca

SEQ ID NO: 813031 - DNA, 20 bp, Artificial
  CRISPR gRNA sequence
acaacagtatatagcttcaa

SEQ ID NO: 813032 - DNA, 20 bp, Artificial
  CRISPR gRNA sequence
caaatagccagaaggggtac

SEQ ID NO: 813033 - DNA, 20 bp, Artificial
  CRISPR gRNA sequence
aaatagccagaaggggtaca

SEQ ID NO: 813034 - DNA, 20 bp, Artificial
  CRISPR gRNA sequence
aatgttctcaacacaaagaa

SEQ ID NO: 813035 - DNA, 20 bp, Artificial
  CRISPR gRNA sequence
tcaacacaaagaaataataa

SEQ ID NO: 813036 - DNA, 20 bp, Artificial
  CRISPR gRNA sequence
aacacaaagaaataataaat

SEQ ID NO: 813037 - DNA, 20 bp, Artificial
  CRISPR gRNA sequence
gagatgataaatatgctaat

SEQ ID NO: 813038 - DNA, 20 bp, Artificial
  CRISPR gRNA sequence
agatgataaatatgctaatt

SEQ ID NO: 813039 - DNA, 20 bp, Artificial
  CRISPR gRNA sequence
attaccccgatctgatcact

SEQ ID NO: 813040 - DNA, 20 bp, Artificial
  CRISPR gRNA sequence
ccccgatctgatcactatac

SEQ ID NO: 813041 - DNA, 20 bp, Artificial
  CRISPR gRNA sequence
atcactatacattgtatata

SEQ ID NO: 813042 - DNA, 20 bp, Artificial
  CRISPR gRNA sequence
tacattgtatatattgaaac

SEQ ID NO: 813043 - DNA, 20 bp, Artificial
  CRISPR gRNA sequence
tatatattgaaacatcacta

SEQ ID NO: 813044 - DNA, 20 bp, Artificial
  CRISPR gRNA sequence
aaacatcactatgtatccca

SEQ ID NO: 813045 - DNA, 20 bp, Artificial
  CRISPR gRNA sequence
tgtatcccataaataagtac

SEQ ID NO: 813046 - DNA, 20 bp, Artificial
  CRISPR gRNA sequence
ttgtcaattaaaaaaagata

SEQ ID NO: 813047 - DNA, 20 bp, Artificial
  CRISPR gRNA sequence
tcaattaaaaaaagataaaa

SEQ ID NO: 813048 - DNA, 20 bp, Artificial
  CRISPR gRNA sequence
aaaaaagataaaatacattc

SEQ ID NO: 813049 - DNA, 20 bp, Artificial
  CRISPR gRNA sequence
acatatacccaaaaaaatga

SEQ ID NO: 813050 - DNA, 20 bp, Artificial
  CRISPR gRNA sequence
aaaagaaggtgcacataact

SEQ ID NO: 813051 - DNA, 20 bp, Artificial
  CRISPR gRNA sequence
cacaattttttctgctgtta

SEQ ID NO: 813052 - DNA, 20 bp, Artificial
  CRISPR gRNA sequence
acaattttttctgctgttat

SEQ ID NO: 813053 - DNA, 20 bp, Artificial
  CRISPR gRNA sequence
tttctgctgttatatctgtt

SEQ ID NO: 813054 - DNA, 20 bp, Artificial
  CRISPR gRNA sequence
ttctgctgttatatctgtta

SEQ ID NO: 813055 - DNA, 20 bp, Artificial
  CRISPR gRNA sequence
tctgctgttatatctgttat

SEQ ID NO: 813056 - DNA, 20 bp, Artificial
  CRISPR gRNA sequence
ctgctgttatatctgttatt

SEQ ID NO: 813057 - DNA, 20 bp, Artificial
  CRISPR gRNA sequence
tgctgttatatctgttattg

SEQ ID NO: 813058 - DNA, 20 bp, Artificial
  CRISPR gRNA sequence
ctgttatatctgttattgct

SEQ ID NO: 813059 - DNA, 20 bp, Artificial
  CRISPR gRNA sequence
ttatatctgttattgcttgt

SEQ ID NO: 813060 - DNA, 20 bp, Artificial
  CRISPR gRNA sequence
tatctgttattgcttgtaat

SEQ ID NO: 813061 - DNA, 20 bp, Artificial
  CRISPR gRNA sequence
ttattgcttgtaatcatgtt

SEQ ID NO: 813062 - DNA, 20 bp, Artificial
  CRISPR gRNA sequence
ttgcttgtaatcatgttttc

SEQ ID NO: 813063 - DNA, 20 bp, Artificial
  CRISPR gRNA sequence
cttgtaatcatgttttcaca

SEQ ID NO: 813064 - DNA, 20 bp, Artificial
  CRISPR gRNA sequence
gtaatcatgttttcacaata

SEQ ID NO: 813065 - DNA, 20 bp, Artificial
  CRISPR gRNA sequence
taatcatgttttcacaataa

SEQ ID NO: 813066 - DNA, 20 bp, Artificial
  CRISPR gRNA sequence
tcacaataaacttaatgtgt

SEQ ID NO: 813067 - DNA, 20 bp, Artificial
  CRISPR gRNA sequence
cacaataaacttaatgtgtc

SEQ ID NO: 813068 - DNA, 20 bp, Artificial
  CRISPR gRNA sequence
acaataaacttaatgtgtca

SEQ ID NO: 813069 - DNA, 20 bp, Artificial
  CRISPR gRNA sequence
aatgtgtcaatttctttttt

SEQ ID NO: 813070 - DNA, 20 bp, Artificial
  CRISPR gRNA sequence
atgtgtcaatttcttttttt

SEQ ID NO: 813071 - DNA, 20 bp, Artificial
  CRISPR gRNA sequence
cttttttttttttttctttt

SEQ ID NO: 813072 - DNA, 20 bp, Artificial
  CRISPR gRNA sequence
ttttttttttttttcttttt

SEQ ID NO: 813073 - DNA, 20 bp, Artificial
  CRISPR gRNA sequence
ttttttttttttcttttttt

SEQ ID NO: 813074 - DNA, 20 bp, Artificial
  CRISPR gRNA sequence
tttttttttttctttttttg

SEQ ID NO: 813075 - DNA, 20 bp, Artificial
  CRISPR gRNA sequence
ttttttttttctttttttga

SEQ ID NO: 813076 - DNA, 20 bp, Artificial
  CRISPR gRNA sequence
tttttttttctttttttgag

SEQ ID NO: 813077 - DNA, 20 bp, Artificial
  CRISPR gRNA sequence
ttttttttctttttttgaga

SEQ ID NO: 813078 - DNA, 20 bp, Artificial
  CRISPR gRNA sequence
tttttttctttttttgagac

SEQ ID NO: 813079 - DNA, 20 bp, Artificial
  CRISPR gRNA sequence
ttttttctttttttgagaca

SEQ ID NO: 813080 - DNA, 20 bp, Artificial
  CRISPR gRNA sequence
tttttctttttttgagacag

SEQ ID NO: 813081 - DNA, 20 bp, Artificial
  CRISPR gRNA sequence
ttttctttttttgagacaga

SEQ ID NO: 813082 - DNA, 20 bp, Artificial
  CRISPR gRNA sequence
tttctttttttgagacagag

SEQ ID NO: 813083 - DNA, 20 bp, Artificial
  CRISPR gRNA sequence
ttctttttttgagacagagt

SEQ ID NO: 813084 - DNA, 20 bp, Artificial
  CRISPR gRNA sequence
tctttttttgagacagagtc

SEQ ID NO: 813085 - DNA, 20 bp, Artificial
  CRISPR gRNA sequence
ctttttttgagacagagtct

SEQ ID NO: 813086 - DNA, 20 bp, Artificial
  CRISPR gRNA sequence
tttttttgagacagagtctc

SEQ ID NO: 813087 - DNA, 20 bp, Artificial
  CRISPR gRNA sequence
tttttgagacagagtctcgc

SEQ ID NO: 813088 - DNA, 20 bp, Artificial
  CRISPR gRNA sequence
ttttgagacagagtctcgct

SEQ ID NO: 813089 - DNA, 20 bp, Artificial
  CRISPR gRNA sequence
tttgagacagagtctcgctc

SEQ ID NO: 813090 - DNA, 20 bp, Artificial
  CRISPR gRNA sequence
ttgagacagagtctcgctct

SEQ ID NO: 813091 - DNA, 20 bp, Artificial
  CRISPR gRNA sequence
tgagacagagtctcgctctg

SEQ ID NO: 813092 - DNA, 20 bp, Artificial
  CRISPR gRNA sequence
gagacagagtctcgctctgt

SEQ ID NO: 813093 - DNA, 20 bp, Artificial
  CRISPR gRNA sequence
agacagagtctcgctctgtc

SEQ ID NO: 813094 - DNA, 20 bp, Artificial
  CRISPR gRNA sequence
gctctgtcgcccaggctgga

SEQ ID NO: 813095 - DNA, 20 bp, Artificial
  CRISPR gRNA sequence
tgtcgcccaggctggagtgc

SEQ ID NO: 813096 - DNA, 20 bp, Artificial
  CRISPR gRNA sequence
tcgcccaggctggagtgcag

SEQ ID NO: 813097 - DNA, 20 bp, Artificial
  CRISPR gRNA sequence
gagtgcagtggagcgatctc

SEQ ID NO: 813098 - DNA, 20 bp, Artificial
  CRISPR gRNA sequence
ggctcactacaagctccgcc

SEQ ID NO: 813099 - DNA, 20 bp, Artificial
  CRISPR gRNA sequence
actacaagctccgcctcccg

SEQ ID NO: 813100 - DNA, 20 bp, Artificial
  CRISPR gRNA sequence
caagctccgcctcccggctt

SEQ ID NO: 813101 - DNA, 20 bp, Artificial
  CRISPR gRNA sequence
cgcctcccggcttaacgcca

SEQ ID NO: 813102 - DNA, 20 bp, Artificial
  CRISPR gRNA sequence
ccggcttaacgccattctcc

SEQ ID NO: 813103 - DNA, 20 bp, Artificial
  CRISPR gRNA sequence
aacgccattctcctgcctca

SEQ ID NO: 813104 - DNA, 20 bp, Artificial
  CRISPR gRNA sequence
acgccattctcctgcctcag

SEQ ID NO: 813105 - DNA, 20 bp, Artificial
  CRISPR gRNA sequence
tcctgcctcagcctccccag

SEQ ID NO: 813106 - DNA, 20 bp, Artificial
  CRISPR gRNA sequence
ctgcctcagcctccccagta

SEQ ID NO: 813107 - DNA, 20 bp, Artificial
  CRISPR gRNA sequence
cctcagcctccccagtagct

SEQ ID NO: 813108 - DNA, 20 bp, Artificial
  CRISPR gRNA sequence
agcctccccagtagctggga

SEQ ID NO: 813109 - DNA, 20 bp, Artificial
  CRISPR gRNA sequence
cccagtagctgggactacag

SEQ ID NO: 813110 - DNA, 20 bp, Artificial
  CRISPR gRNA sequence
ggactacaggcgcccgccac

SEQ ID NO: 813111 - DNA, 20 bp, Artificial
  CRISPR gRNA sequence
caggcgcccgccaccgcgcc

SEQ ID NO: 813112 - DNA, 20 bp, Artificial
  CRISPR gRNA sequence
atttttgttgtattttttag

SEQ ID NO: 813113 - DNA, 20 bp, Artificial
  CRISPR gRNA sequence
ttgttgtattttttagtaga

SEQ ID NO: 813114 - DNA, 20 bp, Artificial
  CRISPR gRNA sequence
tgttgtattttttagtagag

SEQ ID NO: 813115 - DNA, 20 bp, Artificial
  CRISPR gRNA sequence
gttgtattttttagtagaga

SEQ ID NO: 813116 - DNA, 20 bp, Artificial
  CRISPR gRNA sequence
ttgtattttttagtagagac

SEQ ID NO: 813117 - DNA, 20 bp, Artificial
  CRISPR gRNA sequence
tattttttagtagagacagg

SEQ ID NO: 813118 - DNA, 20 bp, Artificial
  CRISPR gRNA sequence
tttagtagagacagggtttc

SEQ ID NO: 813119 - DNA, 20 bp, Artificial
  CRISPR gRNA sequence
ttagtagagacagggtttca

SEQ ID NO: 813120 - DNA, 20 bp, Artificial
  CRISPR gRNA sequence
tagtagagacagggtttcac

SEQ ID NO: 813121 - DNA, 20 bp, Artificial
  CRISPR gRNA sequence
agtagagacagggtttcacc

SEQ ID NO: 813122 - DNA, 20 bp, Artificial
  CRISPR gRNA sequence
gtagagacagggtttcacca

SEQ ID NO: 813123 - DNA, 20 bp, Artificial
  CRISPR gRNA sequence
caccatgttagccaggatgg

SEQ ID NO: 813124 - DNA, 20 bp, Artificial
  CRISPR gRNA sequence
accatgttagccaggatggt

SEQ ID NO: 813125 - DNA, 20 bp, Artificial
  CRISPR gRNA sequence
gccaggatggtctcgatctc

SEQ ID NO: 813126 - DNA, 20 bp, Artificial
  CRISPR gRNA sequence
gatctcctgacctcatgatc

SEQ ID NO: 813127 - DNA, 20 bp, Artificial
  CRISPR gRNA sequence
ctgacctcatgatccacccg

SEQ ID NO: 813128 - DNA, 20 bp, Artificial
  CRISPR gRNA sequence
acctcatgatccacccgcct

SEQ ID NO: 813129 - DNA, 20 bp, Artificial
  CRISPR gRNA sequence
atgatccacccgccttggcc

SEQ ID NO: 813130 - DNA, 20 bp, Artificial
  CRISPR gRNA sequence
ggcctcccaaagtgctggga

SEQ ID NO: 813131 - DNA, 20 bp, Artificial
  CRISPR gRNA sequence
gcctcccaaagtgctgggat

SEQ ID NO: 813132 - DNA, 20 bp, Artificial
  CRISPR gRNA sequence
ccaaagtgctgggattacgg

SEQ ID NO: 813133 - DNA, 20 bp, Artificial
  CRISPR gRNA sequence
ggattacggtcgtgagccac

SEQ ID NO: 813134 - DNA, 20 bp, Artificial
  CRISPR gRNA sequence
cggtcgtgagccaccgcgcc

SEQ ID NO: 813135 - DNA, 20 bp, Artificial
  CRISPR gRNA sequence
atgtgtccatttctaaaata

SEQ ID NO: 813136 - DNA, 20 bp, Artificial
  CRISPR gRNA sequence
ctaaaatatatatatatagt

SEQ ID NO: 813137 - DNA, 20 bp, Artificial
  CRISPR gRNA sequence
taaaatatatatatatagta

SEQ ID NO: 813138 - DNA, 20 bp, Artificial
  CRISPR gRNA sequence
aaatatatatatatagtaca

SEQ ID NO: 813139 - DNA, 20 bp, Artificial
  CRISPR gRNA sequence
ccacaagaaaaaaaatatat

SEQ ID NO: 813140 - DNA, 20 bp, Artificial
  CRISPR gRNA sequence
cacaagaaaaaaaatatatg

SEQ ID NO: 813141 - DNA, 20 bp, Artificial
  CRISPR gRNA sequence
aaacaatattacatatttta

SEQ ID NO: 813142 - DNA, 20 bp, Artificial
  CRISPR gRNA sequence
catattttaaataagctctt

SEQ ID NO: 813143 - DNA, 20 bp, Artificial
  CRISPR gRNA sequence
taaataagctcttacaaaca

SEQ ID NO: 813144 - DNA, 20 bp, Artificial
  CRISPR gRNA sequence
aaataagctcttacaaacaa

SEQ ID NO: 813145 - DNA, 20 bp, Artificial
  CRISPR gRNA sequence
aataagctcttacaaacaaa

SEQ ID NO: 813146 - DNA, 20 bp, Artificial
  CRISPR gRNA sequence
ttacaaacaaaagaatatgt

SEQ ID NO: 813147 - DNA, 20 bp, Artificial
  CRISPR gRNA sequence
acaaacaaaagaatatgtat

SEQ ID NO: 813148 - DNA, 20 bp, Artificial
  CRISPR gRNA sequence
caaacaaaagaatatgtatg

SEQ ID NO: 813149 - DNA, 20 bp, Artificial
  CRISPR gRNA sequence
gaataatttcctgtgttaaa

SEQ ID NO: 813150 - DNA, 20 bp, Artificial
  CRISPR gRNA sequence
cctgtgttaaaaaaggggaa

SEQ ID NO: 813151 - DNA, 20 bp, Artificial
  CRISPR gRNA sequence
ctgtgttaaaaaaggggaat

SEQ ID NO: 813152 - DNA, 20 bp, Artificial
  CRISPR gRNA sequence
tgttaaaaaaggggaatgag

SEQ ID NO: 813153 - DNA, 20 bp, Artificial
  CRISPR gRNA sequence
aaaaaggggaatgagactgg

SEQ ID NO: 813154 - DNA, 20 bp, Artificial
  CRISPR gRNA sequence
gagaatgtggaaaaaagaga

SEQ ID NO: 813155 - DNA, 20 bp, Artificial
  CRISPR gRNA sequence
tttgggtaaggaacctaatc

SEQ ID NO: 813156 - DNA, 20 bp, Artificial
  CRISPR gRNA sequence
ttgggtaaggaacctaatct

SEQ ID NO: 813157 - DNA, 20 bp, Artificial
  CRISPR gRNA sequence
tgggtaaggaacctaatcta

SEQ ID NO: 813158 - DNA, 20 bp, Artificial
  CRISPR gRNA sequence
gggtaaggaacctaatctat

SEQ ID NO: 813159 - DNA, 20 bp, Artificial
  CRISPR gRNA sequence
ggtaaggaacctaatctatt

SEQ ID NO: 813160 - DNA, 20 bp, Artificial
  CRISPR gRNA sequence
atctattcaattccttctaa

SEQ ID NO: 813161 - DNA, 20 bp, Artificial
  CRISPR gRNA sequence
ttcaattccttctaagtaaa

SEQ ID NO: 813162 - DNA, 20 bp, Artificial
  CRISPR gRNA sequence
aattccttctaagtaaaaat

SEQ ID NO: 813163 - DNA, 20 bp, Artificial
  CRISPR gRNA sequence
cttctaagtaaaaataaata

SEQ ID NO: 813164 - DNA, 20 bp, Artificial
  CRISPR gRNA sequence
ctaagtaaaaataaataaat

SEQ ID NO: 813165 - DNA, 20 bp, Artificial
  CRISPR gRNA sequence
taagtaaaaataaataaatt

SEQ ID NO: 813166 - DNA, 20 bp, Artificial
  CRISPR gRNA sequence
agtaaaaataaataaattat

SEQ ID NO: 813167 - DNA, 20 bp, Artificial
  CRISPR gRNA sequence
ttaaatgaaaaaattcttct

SEQ ID NO: 813168 - DNA, 20 bp, Artificial
  CRISPR gRNA sequence
aatgaaaaaattcttctctg

SEQ ID NO: 813169 - DNA, 20 bp, Artificial
  CRISPR gRNA sequence
ttctctgtctaaattgtttc

SEQ ID NO: 813170 - DNA, 20 bp, Artificial
  CRISPR gRNA sequence
ctctgtctaaattgtttctt

SEQ ID NO: 813171 - DNA, 20 bp, Artificial
  CRISPR gRNA sequence
tctgtctaaattgtttcttt

SEQ ID NO: 813172 - DNA, 20 bp, Artificial
  CRISPR gRNA sequence
tgtctaaattgtttcttttc

SEQ ID NO: 813173 - DNA, 20 bp, Artificial
  CRISPR gRNA sequence
tctaaattgtttcttttcat

SEQ ID NO: 813174 - DNA, 20 bp, Artificial
  CRISPR gRNA sequence
aattgtttcttttcattcat

SEQ ID NO: 813175 - DNA, 20 bp, Artificial
  CRISPR gRNA sequence
tttcttttcattcattgaaa

SEQ ID NO: 813176 - DNA, 20 bp, Artificial
  CRISPR gRNA sequence
cttttcattcattgaaactc

SEQ ID NO: 813177 - DNA, 20 bp, Artificial
  CRISPR gRNA sequence
ttttcattcattgaaactca

SEQ ID NO: 813178 - DNA, 20 bp, Artificial
  CRISPR gRNA sequence
ttcattcattgaaactcact

SEQ ID NO: 813179 - DNA, 20 bp, Artificial
  CRISPR gRNA sequence
tcattcattgaaactcactt

SEQ ID NO: 813180 - DNA, 20 bp, Artificial
  CRISPR gRNA sequence
cattcattgaaactcacttc

SEQ ID NO: 813181 - DNA, 20 bp, Artificial
  CRISPR gRNA sequence
attcattgaaactcacttcc

SEQ ID NO: 813182 - DNA, 20 bp, Artificial
  CRISPR gRNA sequence
attgaaactcacttccaatt

SEQ ID NO: 813183 - DNA, 20 bp, Artificial
  CRISPR gRNA sequence
aaactcacttccaatttcac

SEQ ID NO: 813184 - DNA, 20 bp, Artificial
  CRISPR gRNA sequence
acttccaatttcaccttccc

SEQ ID NO: 813185 - DNA, 20 bp, Artificial
  CRISPR gRNA sequence
ccaatttcaccttccctaca

SEQ ID NO: 813186 - DNA, 20 bp, Artificial
  CRISPR gRNA sequence
caatttcaccttccctacag

SEQ ID NO: 813187 - DNA, 20 bp, Artificial
  CRISPR gRNA sequence
caccttccctacagaatttt

SEQ ID NO: 813188 - DNA, 20 bp, Artificial
  CRISPR gRNA sequence
accttccctacagaatttta

SEQ ID NO: 813189 - DNA, 20 bp, Artificial
  CRISPR gRNA sequence
ccctacagaattttatctta

SEQ ID NO: 813190 - DNA, 20 bp, Artificial
  CRISPR gRNA sequence
cctacagaattttatcttaa

SEQ ID NO: 813191 - DNA, 20 bp, Artificial
  CRISPR gRNA sequence
cagaattttatcttaatgta

SEQ ID NO: 813192 - DNA, 20 bp, Artificial
  CRISPR gRNA sequence
tatcttaatgtaacatattt

SEQ ID NO: 813193 - DNA, 20 bp, Artificial
  CRISPR gRNA sequence
atcttaatgtaacatatttt

SEQ ID NO: 813194 - DNA, 20 bp, Artificial
  CRISPR gRNA sequence
tcttaatgtaacatattttt

SEQ ID NO: 813195 - DNA, 20 bp, Artificial
  CRISPR gRNA sequence
aatgtaacatatttttgttt

SEQ ID NO: 813196 - DNA, 20 bp, Artificial
  CRISPR gRNA sequence
atgtaacatatttttgtttg

SEQ ID NO: 813197 - DNA, 20 bp, Artificial
  CRISPR gRNA sequence
ttgtttgacagattttgtat

SEQ ID NO: 813198 - DNA, 20 bp, Artificial
  CRISPR gRNA sequence
tgtttgacagattttgtatt

SEQ ID NO: 813199 - DNA, 20 bp, Artificial
  CRISPR gRNA sequence
gtttgacagattttgtattg

SEQ ID NO: 813200 - DNA, 20 bp, Artificial
  CRISPR gRNA sequence
tttgacagattttgtattga

SEQ ID NO: 813201 - DNA, 20 bp, Artificial
  CRISPR gRNA sequence
gacagattttgtattgatta

SEQ ID NO: 813202 - DNA, 20 bp, Artificial
  CRISPR gRNA sequence
acagattttgtattgattat

SEQ ID NO: 813203 - DNA, 20 bp, Artificial
  CRISPR gRNA sequence
tgtattgattatcgttatat

SEQ ID NO: 813204 - DNA, 20 bp, Artificial
  CRISPR gRNA sequence
gtattgattatcgttatatg

SEQ ID NO: 813205 - DNA, 20 bp, Artificial
  CRISPR gRNA sequence
tattgattatcgttatatgt

SEQ ID NO: 813206 - DNA, 20 bp, Artificial
  CRISPR gRNA sequence
attatcgttatatgtcttta

SEQ ID NO: 813207 - DNA, 20 bp, Artificial
  CRISPR gRNA sequence
tcgttatatgtctttacaac

SEQ ID NO: 813208 - DNA, 20 bp, Artificial
  CRISPR gRNA sequence
tatgtctttacaacaacaaa

SEQ ID NO: 813209 - DNA, 20 bp, Artificial
  CRISPR gRNA sequence
tacaacaacaaaatatttat

SEQ ID NO: 813210 - DNA, 20 bp, Artificial
  CRISPR gRNA sequence
acaacaacaaaatatttata

SEQ ID NO: 813211 - DNA, 20 bp, Artificial
  CRISPR gRNA sequence
caacaacaaaatatttatag

SEQ ID NO: 813212 - DNA, 20 bp, Artificial
  CRISPR gRNA sequence
atagctattgaaatgaaaac

SEQ ID NO: 813213 - DNA, 20 bp, Artificial
  CRISPR gRNA sequence
tagctattgaaatgaaaact

SEQ ID NO: 813214 - DNA, 20 bp, Artificial
  CRISPR gRNA sequence
ttgaaatgaaaacttttctc

SEQ ID NO: 813215 - DNA, 20 bp, Artificial
  CRISPR gRNA sequence
aaatgaaaacttttctcttg

SEQ ID NO: 813216 - DNA, 20 bp, Artificial
  CRISPR gRNA sequence
ttctcttgtgactatgaagc

SEQ ID NO: 813217 - DNA, 20 bp, Artificial
  CRISPR gRNA sequence
tctcttgtgactatgaagct

SEQ ID NO: 813218 - DNA, 20 bp, Artificial
  CRISPR gRNA sequence
ctcttgtgactatgaagctt

SEQ ID NO: 813219 - DNA, 20 bp, Artificial
  CRISPR gRNA sequence
tcttgtgactatgaagcttt

SEQ ID NO: 813220 - DNA, 20 bp, Artificial
  CRISPR gRNA sequence
ttgtgactatgaagctttaa

SEQ ID NO: 813221 - DNA, 20 bp, Artificial
  CRISPR gRNA sequence
gtgactatgaagctttaaat

SEQ ID NO: 813222 - DNA, 20 bp, Artificial
  CRISPR gRNA sequence
tgactatgaagctttaaatg

SEQ ID NO: 813223 - DNA, 20 bp, Artificial
  CRISPR gRNA sequence
tgaagctttaaatgttcagg

SEQ ID NO: 813224 - DNA, 20 bp, Artificial
  CRISPR gRNA sequence
taaatgttcagggtgttctg

SEQ ID NO: 813225 - DNA, 20 bp, Artificial
  CRISPR gRNA sequence
aaatgttcagggtgttctgc

SEQ ID NO: 813226 - DNA, 20 bp, Artificial
  CRISPR gRNA sequence
aatgttcagggtgttctgca

SEQ ID NO: 813227 - DNA, 20 bp, Artificial
  CRISPR gRNA sequence
agggtgttctgcattaagat

SEQ ID NO: 813228 - DNA, 20 bp, Artificial
  CRISPR gRNA sequence
tgcattaagatctaattttt

SEQ ID NO: 813229 - DNA, 20 bp, Artificial
  CRISPR gRNA sequence
cattaagatctaattttttt

SEQ ID NO: 813230 - DNA, 20 bp, Artificial
  CRISPR gRNA sequence
agatctaattttttttttta

SEQ ID NO: 813231 - DNA, 20 bp, Artificial
  CRISPR gRNA sequence
atttttttttttaacagtaa

SEQ ID NO: 813232 - DNA, 20 bp, Artificial
  CRISPR gRNA sequence
ttttttttaacagtaagttt

SEQ ID NO: 813233 - DNA, 20 bp, Artificial
  CRISPR gRNA sequence
tttttttaacagtaagtttt

SEQ ID NO: 813234 - DNA, 20 bp, Artificial
  CRISPR gRNA sequence
ttttttaacagtaagtttta

SEQ ID NO: 813235 - DNA, 20 bp, Artificial
  CRISPR gRNA sequence
tttttaacagtaagttttag

SEQ ID NO: 813236 - DNA, 20 bp, Artificial
  CRISPR gRNA sequence
ttttaacagtaagttttagg

SEQ ID NO: 813237 - DNA, 20 bp, Artificial
  CRISPR gRNA sequence
tttaacagtaagttttaggg

SEQ ID NO: 813238 - DNA, 20 bp, Artificial
  CRISPR gRNA sequence
ttaacagtaagttttagggt

SEQ ID NO: 813239 - DNA, 20 bp, Artificial
  CRISPR gRNA sequence
taacagtaagttttagggta

SEQ ID NO: 813240 - DNA, 20 bp, Artificial
  CRISPR gRNA sequence
aacagtaagttttagggtac

SEQ ID NO: 813241 - DNA, 20 bp, Artificial
  CRISPR gRNA sequence
acagtaagttttagggtaca

SEQ ID NO: 813242 - DNA, 20 bp, Artificial
  CRISPR gRNA sequence
tagggtacatgtgcacaacg

SEQ ID NO: 813243 - DNA, 20 bp, Artificial
  CRISPR gRNA sequence
agggtacatgtgcacaacgt

SEQ ID NO: 813244 - DNA, 20 bp, Artificial
  CRISPR gRNA sequence
gggtacatgtgcacaacgtg

SEQ ID NO: 813245 - DNA, 20 bp, Artificial
  CRISPR gRNA sequence
gttacatatgtatacatgtg

SEQ ID NO: 813246 - DNA, 20 bp, Artificial
  CRISPR gRNA sequence
ttacatatgtatacatgtgc

SEQ ID NO: 813247 - DNA, 20 bp, Artificial
  CRISPR gRNA sequence
catatgtatacatgtgccat

SEQ ID NO: 813248 - DNA, 20 bp, Artificial
  CRISPR gRNA sequence
gtgtgctgcacccattaact

SEQ ID NO: 813249 - DNA, 20 bp, Artificial
  CRISPR gRNA sequence
cacccattaacttgtcatta

SEQ ID NO: 813250 - DNA, 20 bp, Artificial
  CRISPR gRNA sequence
acttgtcattaaacattagg

SEQ ID NO: 813251 - DNA, 20 bp, Artificial
  CRISPR gRNA sequence
gtcattaaacattaggtata

SEQ ID NO: 813252 - DNA, 20 bp, Artificial
  CRISPR gRNA sequence
tcattaaacattaggtatat

SEQ ID NO: 813253 - DNA, 20 bp, Artificial
  CRISPR gRNA sequence
aacattaggtatatctccta

SEQ ID NO: 813254 - DNA, 20 bp, Artificial
  CRISPR gRNA sequence
ggtatatctcctaatgctat

SEQ ID NO: 813255 - DNA, 20 bp, Artificial
  CRISPR gRNA sequence
ctaatgctatccctctcccc

SEQ ID NO: 813256 - DNA, 20 bp, Artificial
  CRISPR gRNA sequence
atgctatccctctcccctcc

SEQ ID NO: 813257 - DNA, 20 bp, Artificial
  CRISPR gRNA sequence
tccctctcccctcccccgac

SEQ ID NO: 813258 - DNA, 20 bp, Artificial
  CRISPR gRNA sequence
tcccctcccccgaccacaca

SEQ ID NO: 813259 - DNA, 20 bp, Artificial
  CRISPR gRNA sequence
ccctcccccgaccacacaac

SEQ ID NO: 813260 - DNA, 20 bp, Artificial
  CRISPR gRNA sequence
ccccgaccacacaacagtcc

SEQ ID NO: 813261 - DNA, 20 bp, Artificial
  CRISPR gRNA sequence
ccctccctgtgtccatgtgt

SEQ ID NO: 813262 - DNA, 20 bp, Artificial
  CRISPR gRNA sequence
cctgtgtccatgtgttctca

SEQ ID NO: 813263 - DNA, 20 bp, Artificial
  CRISPR gRNA sequence
tgtccatgtgttctcattgt

SEQ ID NO: 813264 - DNA, 20 bp, Artificial
  CRISPR gRNA sequence
tcattgttcaattcccacct

SEQ ID NO: 813265 - DNA, 20 bp, Artificial
  CRISPR gRNA sequence
attgttcaattcccacctat

SEQ ID NO: 813266 - DNA, 20 bp, Artificial
  CRISPR gRNA sequence
ttcaattcccacctatgagt

SEQ ID NO: 813267 - DNA, 20 bp, Artificial
  CRISPR gRNA sequence
aattcccacctatgagtgag

SEQ ID NO: 813268 - DNA, 20 bp, Artificial
  CRISPR gRNA sequence
ccacctatgagtgagaacat

SEQ ID NO: 813269 - DNA, 20 bp, Artificial
  CRISPR gRNA sequence
tgagtgagaacatgcggtgt

SEQ ID NO: 813270 - DNA, 20 bp, Artificial
  CRISPR gRNA sequence
ggttttttgtccttgggata

SEQ ID NO: 813271 - DNA, 20 bp, Artificial
  CRISPR gRNA sequence
gttttttgtccttgggatag

SEQ ID NO: 813272 - DNA, 20 bp, Artificial
  CRISPR gRNA sequence
tttgtccttgggatagtttg

SEQ ID NO: 813273 - DNA, 20 bp, Artificial
  CRISPR gRNA sequence
ttgtccttgggatagtttgc

SEQ ID NO: 813274 - DNA, 20 bp, Artificial
  CRISPR gRNA sequence
tgtccttgggatagtttgct

SEQ ID NO: 813275 - DNA, 20 bp, Artificial
  CRISPR gRNA sequence
gtccttgggatagtttgctg

SEQ ID NO: 813276 - DNA, 20 bp, Artificial
  CRISPR gRNA sequence
tccttgggatagtttgctga

SEQ ID NO: 813277 - DNA, 20 bp, Artificial
  CRISPR gRNA sequence
gggatagtttgctgagaatg

SEQ ID NO: 813278 - DNA, 20 bp, Artificial
  CRISPR gRNA sequence
ggatagtttgctgagaatga

SEQ ID NO: 813279 - DNA, 20 bp, Artificial
  CRISPR gRNA sequence
gctgagaatgatggtttcca

SEQ ID NO: 813280 - DNA, 20 bp, Artificial
  CRISPR gRNA sequence
ctgagaatgatggtttccag

SEQ ID NO: 813281 - DNA, 20 bp, Artificial
  CRISPR gRNA sequence
agaatgatggtttccagctt

SEQ ID NO: 813282 - DNA, 20 bp, Artificial
  CRISPR gRNA sequence
ccagcttcatccatgtccct

SEQ ID NO: 813283 - DNA, 20 bp, Artificial
  CRISPR gRNA sequence
cagcttcatccatgtcccta

SEQ ID NO: 813284 - DNA, 20 bp, Artificial
  CRISPR gRNA sequence
catccatgtccctacgaagg

SEQ ID NO: 813285 - DNA, 20 bp, Artificial
  CRISPR gRNA sequence
atccatgtccctacgaagga

SEQ ID NO: 813286 - DNA, 20 bp, Artificial
  CRISPR gRNA sequence
cgaaggacatgaactcatca

SEQ ID NO: 813287 - DNA, 20 bp, Artificial
  CRISPR gRNA sequence
atcattttttatggctgcat

SEQ ID NO: 813288 - DNA, 20 bp, Artificial
  CRISPR gRNA sequence
tttatggctgcatagtattc

SEQ ID NO: 813289 - DNA, 20 bp, Artificial
  CRISPR gRNA sequence
ttatggctgcatagtattct

SEQ ID NO: 813290 - DNA, 20 bp, Artificial
  CRISPR gRNA sequence
tatggctgcatagtattcta

SEQ ID NO: 813291 - DNA, 20 bp, Artificial
  CRISPR gRNA sequence
atggctgcatagtattctat

SEQ ID NO: 813292 - DNA, 20 bp, Artificial
  CRISPR gRNA sequence
tggctgcatagtattctatg

SEQ ID NO: 813293 - DNA, 20 bp, Artificial
  CRISPR gRNA sequence
catagtattctatggtgtat

SEQ ID NO: 813294 - DNA, 20 bp, Artificial
  CRISPR gRNA sequence
tatggtgtatacgtgccaca

SEQ ID NO: 813295 - DNA, 20 bp, Artificial
  CRISPR gRNA sequence
tggtgtatacgtgccacatt

SEQ ID NO: 813296 - DNA, 20 bp, Artificial
  CRISPR gRNA sequence
tcttaatccagtctatcgtt

SEQ ID NO: 813297 - DNA, 20 bp, Artificial
  CRISPR gRNA sequence
cttaatccagtctatcgttg

SEQ ID NO: 813298 - DNA, 20 bp, Artificial
  CRISPR gRNA sequence
ttaatccagtctatcgttgt

SEQ ID NO: 813299 - DNA, 20 bp, Artificial
  CRISPR gRNA sequence
aatccagtctatcgttgttg

SEQ ID NO: 813300 - DNA, 20 bp, Artificial
  CRISPR gRNA sequence
atccagtctatcgttgttgg

SEQ ID NO: 813301 - DNA, 20 bp, Artificial
  CRISPR gRNA sequence
tcgttgttggacatttattt

SEQ ID NO: 813302 - DNA, 20 bp, Artificial
  CRISPR gRNA sequence
ttggacatttatttctatta

SEQ ID NO: 813303 - DNA, 20 bp, Artificial
  CRISPR gRNA sequence
gacatttatttctattatta

SEQ ID NO: 813304 - DNA, 20 bp, Artificial
  CRISPR gRNA sequence
atttctattattattaacac

SEQ ID NO: 813305 - DNA, 20 bp, Artificial
  CRISPR gRNA sequence
tttctattattattaacaca

SEQ ID NO: 813306 - DNA, 20 bp, Artificial
  CRISPR gRNA sequence
ctattattattaacacatat

SEQ ID NO: 813307 - DNA, 20 bp, Artificial
  CRISPR gRNA sequence
tattattattaacacatatt

SEQ ID NO: 813308 - DNA, 20 bp, Artificial
  CRISPR gRNA sequence
ttattattaacacatatttg

SEQ ID NO: 813309 - DNA, 20 bp, Artificial
  CRISPR gRNA sequence
ttattaacacatatttgatc

SEQ ID NO: 813310 - DNA, 20 bp, Artificial
  CRISPR gRNA sequence
ttaacacatatttgatcaaa

SEQ ID NO: 813311 - DNA, 20 bp, Artificial
  CRISPR gRNA sequence
acacatatttgatcaaaatg

SEQ ID NO: 813312 - DNA, 20 bp, Artificial
  CRISPR gRNA sequence
gatcaaaatgtaaaatgtta

SEQ ID NO: 813313 - DNA, 20 bp, Artificial
  CRISPR gRNA sequence
atcaaaatgtaaaatgttat

SEQ ID NO: 813314 - DNA, 20 bp, Artificial
  CRISPR gRNA sequence
tgaatattgataattattaa

SEQ ID NO: 813315 - DNA, 20 bp, Artificial
  CRISPR gRNA sequence
ataattattaaacatgaaag

SEQ ID NO: 813316 - DNA, 20 bp, Artificial
  CRISPR gRNA sequence
ttaaacatgaaagatgaaaa

SEQ ID NO: 813317 - DNA, 20 bp, Artificial
  CRISPR gRNA sequence
aacatgaaagatgaaaattt

SEQ ID NO: 813318 - DNA, 20 bp, Artificial
  CRISPR gRNA sequence
attgggaatgtgtcccttaa

SEQ ID NO: 813319 - DNA, 20 bp, Artificial
  CRISPR gRNA sequence
ttgggaatgtgtcccttaat

SEQ ID NO: 813320 - DNA, 20 bp, Artificial
  CRISPR gRNA sequence
ggaatgtgtcccttaataag

SEQ ID NO: 813321 - DNA, 20 bp, Artificial
  CRISPR gRNA sequence
aataagatggatatggctct

SEQ ID NO: 813322 - DNA, 20 bp, Artificial
  CRISPR gRNA sequence
ataagatggatatggctctc

SEQ ID NO: 813323 - DNA, 20 bp, Artificial
  CRISPR gRNA sequence
tcttttccaaattattcatg

SEQ ID NO: 813324 - DNA, 20 bp, Artificial
  CRISPR gRNA sequence
ttttccaaattattcatgaa

SEQ ID NO: 813325 - DNA, 20 bp, Artificial
  CRISPR gRNA sequence
ttccaaattattcatgaatc

SEQ ID NO: 813326 - DNA, 20 bp, Artificial
  CRISPR gRNA sequence
tccaaattattcatgaatcc

SEQ ID NO: 813327 - DNA, 20 bp, Artificial
  CRISPR gRNA sequence
ccaaattattcatgaatccg

SEQ ID NO: 813328 - DNA, 20 bp, Artificial
  CRISPR gRNA sequence
caaattattcatgaatccga

SEQ ID NO: 813329 - DNA, 20 bp, Artificial
  CRISPR gRNA sequence
ttcatgaatccgaagaacca

SEQ ID NO: 813330 - DNA, 20 bp, Artificial
  CRISPR gRNA sequence
atgaatccgaagaaccatat

SEQ ID NO: 813331 - DNA, 20 bp, Artificial
  CRISPR gRNA sequence
gaatgattttatataataga

SEQ ID NO: 813332 - DNA, 20 bp, Artificial
  CRISPR gRNA sequence
tatataatagaattcagcct

SEQ ID NO: 813333 - DNA, 20 bp, Artificial
  CRISPR gRNA sequence
atataatagaattcagcctc

SEQ ID NO: 813334 - DNA, 20 bp, Artificial
  CRISPR gRNA sequence
tataatagaattcagcctca

SEQ ID NO: 813335 - DNA, 20 bp, Artificial
  CRISPR gRNA sequence
agcctcaattctatttctat

SEQ ID NO: 813336 - DNA, 20 bp, Artificial
  CRISPR gRNA sequence
aattctatttctatttttca

SEQ ID NO: 813337 - DNA, 20 bp, Artificial
  CRISPR gRNA sequence
tatttctatttttcattttt

SEQ ID NO: 813338 - DNA, 20 bp, Artificial
  CRISPR gRNA sequence
tttctatttttcattttttt

SEQ ID NO: 813339 - DNA, 20 bp, Artificial
  CRISPR gRNA sequence
ctatttttcatttttttgta

SEQ ID NO: 813340 - DNA, 20 bp, Artificial
  CRISPR gRNA sequence
tatttttcatttttttgtag

SEQ ID NO: 813341 - DNA, 20 bp, Artificial
  CRISPR gRNA sequence
tttttcatttttttgtagct

SEQ ID NO: 813342 - DNA, 20 bp, Artificial
  CRISPR gRNA sequence
ttcatttttttgtagcttat

SEQ ID NO: 813343 - DNA, 20 bp, Artificial
  CRISPR gRNA sequence
tcatttttttgtagcttata

SEQ ID NO: 813344 - DNA, 20 bp, Artificial
  CRISPR gRNA sequence
catttttttgtagcttataa

SEQ ID NO: 813345 - DNA, 20 bp, Artificial
  CRISPR gRNA sequence
atttttttgtagcttataaa

SEQ ID NO: 813346 - DNA, 20 bp, Artificial
  CRISPR gRNA sequence
ttttgtagcttataaaggct

SEQ ID NO: 813347 - DNA, 20 bp, Artificial
  CRISPR gRNA sequence
tttgtagcttataaaggcta

SEQ ID NO: 813348 - DNA, 20 bp, Artificial
  CRISPR gRNA sequence
ttgtagcttataaaggctaa

SEQ ID NO: 813349 - DNA, 20 bp, Artificial
  CRISPR gRNA sequence
tgtagcttataaaggctaag

SEQ ID NO: 813350 - DNA, 20 bp, Artificial
  CRISPR gRNA sequence
gtagcttataaaggctaagg

SEQ ID NO: 813351 - DNA, 20 bp, Artificial
  CRISPR gRNA sequence
tagcttataaaggctaagga

SEQ ID NO: 813352 - DNA, 20 bp, Artificial
  CRISPR gRNA sequence
ataaaggctaaggaatcttg

SEQ ID NO: 813353 - DNA, 20 bp, Artificial
  CRISPR gRNA sequence
taaaggctaaggaatcttgt

SEQ ID NO: 813354 - DNA, 20 bp, Artificial
  CRISPR gRNA sequence
aggaatcttgttcgtatgag

SEQ ID NO: 813355 - DNA, 20 bp, Artificial
  CRISPR gRNA sequence
gttcgtatgagtaaatcaat

SEQ ID NO: 813356 - DNA, 20 bp, Artificial
  CRISPR gRNA sequence
ttcgtatgagtaaatcaatg

SEQ ID NO: 813357 - DNA, 20 bp, Artificial
  CRISPR gRNA sequence
gtatgagtaaatcaatggga

SEQ ID NO: 813358 - DNA, 20 bp, Artificial
  CRISPR gRNA sequence
cgttacagcaatgccatttc

SEQ ID NO: 813359 - DNA, 20 bp, Artificial
  CRISPR gRNA sequence
gttacagcaatgccatttca

SEQ ID NO: 813360 - DNA, 20 bp, Artificial
  CRISPR gRNA sequence
cagcaatgccatttcattct

SEQ ID NO: 813361 - DNA, 20 bp, Artificial
  CRISPR gRNA sequence
cattctttgacctgatttac

SEQ ID NO: 813362 - DNA, 20 bp, Artificial
  CRISPR gRNA sequence
attctttgacctgatttaca

SEQ ID NO: 813363 - DNA, 20 bp, Artificial
  CRISPR gRNA sequence
tttgacctgatttacatggc

SEQ ID NO: 813364 - DNA, 20 bp, Artificial
  CRISPR gRNA sequence
tgacctgatttacatggcaa

SEQ ID NO: 813365 - DNA, 20 bp, Artificial
  CRISPR gRNA sequence
gacctgatttacatggcaaa

SEQ ID NO: 813366 - DNA, 20 bp, Artificial
  CRISPR gRNA sequence
acctgatttacatggcaaaa

SEQ ID NO: 813367 - DNA, 20 bp, Artificial
  CRISPR gRNA sequence
atttacatggcaaaaattac

SEQ ID NO: 813368 - DNA, 20 bp, Artificial
  CRISPR gRNA sequence
acatggcaaaaattactcat

SEQ ID NO: 813369 - DNA, 20 bp, Artificial
  CRISPR gRNA sequence
catggcaaaaattactcatt

SEQ ID NO: 813370 - DNA, 20 bp, Artificial
  CRISPR gRNA sequence
ctcatttttgattatcagtt

SEQ ID NO: 813371 - DNA, 20 bp, Artificial
  CRISPR gRNA sequence
atttttgattatcagttatt

SEQ ID NO: 813372 - DNA, 20 bp, Artificial
  CRISPR gRNA sequence
ttgattatcagttattaact

SEQ ID NO: 813373 - DNA, 20 bp, Artificial
  CRISPR gRNA sequence
tgattatcagttattaactt

SEQ ID NO: 813374 - DNA, 20 bp, Artificial
  CRISPR gRNA sequence
gattatcagttattaacttt

SEQ ID NO: 813375 - DNA, 20 bp, Artificial
  CRISPR gRNA sequence
attatcagttattaacttta

SEQ ID NO: 813376 - DNA, 20 bp, Artificial
  CRISPR gRNA sequence
tcagttattaactttataag

SEQ ID NO: 813377 - DNA, 20 bp, Artificial
  CRISPR gRNA sequence
ttaactttataagggcctcc

SEQ ID NO: 813378 - DNA, 20 bp, Artificial
  CRISPR gRNA sequence
actttataagggcctccttc

SEQ ID NO: 813379 - DNA, 20 bp, Artificial
  CRISPR gRNA sequence
tataagggcctccttcaatt

SEQ ID NO: 813380 - DNA, 20 bp, Artificial
  CRISPR gRNA sequence
ataagggcctccttcaattt

SEQ ID NO: 813381 - DNA, 20 bp, Artificial
  CRISPR gRNA sequence
taagggcctccttcaatttt

SEQ ID NO: 813382 - DNA, 20 bp, Artificial
  CRISPR gRNA sequence
cttcaattttgttgaaagca

SEQ ID NO: 813383 - DNA, 20 bp, Artificial
  CRISPR gRNA sequence
caattttgttgaaagcagaa

SEQ ID NO: 813384 - DNA, 20 bp, Artificial
  CRISPR gRNA sequence
aattttgttgaaagcagaaa

SEQ ID NO: 813385 - DNA, 20 bp, Artificial
  CRISPR gRNA sequence
tgttgaaagcagaaaattag

SEQ ID NO: 813386 - DNA, 20 bp, Artificial
  CRISPR gRNA sequence
gttgaaagcagaaaattaga

SEQ ID NO: 813387 - DNA, 20 bp, Artificial
  CRISPR gRNA sequence
ttgaaagcagaaaattagat

SEQ ID NO: 813388 - DNA, 20 bp, Artificial
  CRISPR gRNA sequence
aaagcagaaaattagatacc

SEQ ID NO: 813389 - DNA, 20 bp, Artificial
  CRISPR gRNA sequence
gataccacattatttgcaaa

SEQ ID NO: 813390 - DNA, 20 bp, Artificial
  CRISPR gRNA sequence
tttgcaaaagggtttttagt

SEQ ID NO: 813391 - DNA, 20 bp, Artificial
  CRISPR gRNA sequence
gcaaaagggtttttagtcat

SEQ ID NO: 813392 - DNA, 20 bp, Artificial
  CRISPR gRNA sequence
caaaagggtttttagtcata

SEQ ID NO: 813393 - DNA, 20 bp, Artificial
  CRISPR gRNA sequence
ttagtcataacagttccatc

SEQ ID NO: 813394 - DNA, 20 bp, Artificial
  CRISPR gRNA sequence
tagtcataacagttccatca

SEQ ID NO: 813395 - DNA, 20 bp, Artificial
  CRISPR gRNA sequence
agtcataacagttccatcag

SEQ ID NO: 813396 - DNA, 20 bp, Artificial
  CRISPR gRNA sequence
gtcataacagttccatcagg

SEQ ID NO: 813397 - DNA, 20 bp, Artificial
  CRISPR gRNA sequence
catcaggtgtcaatgttccc

SEQ ID NO: 813398 - DNA, 20 bp, Artificial
  CRISPR gRNA sequence
ccaatcattcttttatttaa

SEQ ID NO: 813399 - DNA, 20 bp, Artificial
  CRISPR gRNA sequence
ttttatttaacactatagag

SEQ ID NO: 813400 - DNA, 20 bp, Artificial
  CRISPR gRNA sequence
ttatttaacactatagaggg

SEQ ID NO: 813401 - DNA, 20 bp, Artificial
  CRISPR gRNA sequence
tatttaacactatagagggt

SEQ ID NO: 813402 - DNA, 20 bp, Artificial
  CRISPR gRNA sequence
atttaacactatagagggtt

SEQ ID NO: 813403 - DNA, 20 bp, Artificial
  CRISPR gRNA sequence
tttaacactatagagggttt

SEQ ID NO: 813404 - DNA, 20 bp, Artificial
  CRISPR gRNA sequence
aacactatagagggttttac

SEQ ID NO: 813405 - DNA, 20 bp, Artificial
  CRISPR gRNA sequence
acactatagagggttttaca

SEQ ID NO: 813406 - DNA, 20 bp, Artificial
  CRISPR gRNA sequence
tagagggttttacaccctgg

SEQ ID NO: 813407 - DNA, 20 bp, Artificial
  CRISPR gRNA sequence
tacaccctgggacaatggac

SEQ ID NO: 813408 - DNA, 20 bp, Artificial
  CRISPR gRNA sequence
acaccctgggacaatggact

SEQ ID NO: 813409 - DNA, 20 bp, Artificial
  CRISPR gRNA sequence
caccctgggacaatggacta

SEQ ID NO: 813410 - DNA, 20 bp, Artificial
  CRISPR gRNA sequence
ggacaatggactatattcat

SEQ ID NO: 813411 - DNA, 20 bp, Artificial
  CRISPR gRNA sequence
tattcatgatgagtgagtgg

SEQ ID NO: 813412 - DNA, 20 bp, Artificial
  CRISPR gRNA sequence
atgatgagtgagtggtaggc

SEQ ID NO: 813413 - DNA, 20 bp, Artificial
  CRISPR gRNA sequence
aaaagaggaagtgttttagg

SEQ ID NO: 813414 - DNA, 20 bp, Artificial
  CRISPR gRNA sequence
aaagaggaagtgttttaggg

SEQ ID NO: 813415 - DNA, 20 bp, Artificial
  CRISPR gRNA sequence
taggggaaccccaagagcct

SEQ ID NO: 813416 - DNA, 20 bp, Artificial
  CRISPR gRNA sequence
aggggaaccccaagagcctt

SEQ ID NO: 813417 - DNA, 20 bp, Artificial
  CRISPR gRNA sequence
ggggaaccccaagagccttg

SEQ ID NO: 813418 - DNA, 20 bp, Artificial
  CRISPR gRNA sequence
gcctggcatgcacattgtca

SEQ ID NO: 813419 - DNA, 20 bp, Artificial
  CRISPR gRNA sequence
cctggcatgcacattgtcag

SEQ ID NO: 813420 - DNA, 20 bp, Artificial
  CRISPR gRNA sequence
gcatgcacattgtcaggctc

SEQ ID NO: 813421 - DNA, 20 bp, Artificial
  CRISPR gRNA sequence
tcaggctcgtcaattttggg

SEQ ID NO: 813422 - DNA, 20 bp, Artificial
  CRISPR gRNA sequence
gtcaattttgggaacgagta

SEQ ID NO: 813423 - DNA, 20 bp, Artificial
  CRISPR gRNA sequence
tgggaacgagtatttgggga

SEQ ID NO: 813424 - DNA, 20 bp, Artificial
  CRISPR gRNA sequence
gggaacgagtatttggggaa

SEQ ID NO: 813425 - DNA, 20 bp, Artificial
  CRISPR gRNA sequence
ggaacgagtatttggggaag

SEQ ID NO: 813426 - DNA, 20 bp, Artificial
  CRISPR gRNA sequence
ggggaagatgaggatctagg

SEQ ID NO: 813427 - DNA, 20 bp, Artificial
  CRISPR gRNA sequence
gggaagatgaggatctagga

SEQ ID NO: 813428 - DNA, 20 bp, Artificial
  CRISPR gRNA sequence
ggaactcacttcctaaaact

SEQ ID NO: 813429 - DNA, 20 bp, Artificial
  CRISPR gRNA sequence
acttcctaaaactgcctgtg

SEQ ID NO: 813430 - DNA, 20 bp, Artificial
  CRISPR gRNA sequence
cctaaaactgcctgtgccca

SEQ ID NO: 813431 - DNA, 20 bp, Artificial
  CRISPR gRNA sequence
ctaaaactgcctgtgcccat

SEQ ID NO: 813432 - DNA, 20 bp, Artificial
  CRISPR gRNA sequence
aaactgcctgtgcccataca

SEQ ID NO: 813433 - DNA, 20 bp, Artificial
  CRISPR gRNA sequence
cctgtgcccatacatccctt

SEQ ID NO: 813434 - DNA, 20 bp, Artificial
  CRISPR gRNA sequence
tgcccatacatcccttgaaa

SEQ ID NO: 813435 - DNA, 20 bp, Artificial
  CRISPR gRNA sequence
gaaaagtctttgtaatcccc

SEQ ID NO: 813436 - DNA, 20 bp, Artificial
  CRISPR gRNA sequence
aaaagtctttgtaatcccca

SEQ ID NO: 813437 - DNA, 20 bp, Artificial
  CRISPR gRNA sequence
tgtaatccccaaatatccca

SEQ ID NO: 813438 - DNA, 20 bp, Artificial
  CRISPR gRNA sequence
gtaatccccaaatatcccag

SEQ ID NO: 813439 - DNA, 20 bp, Artificial
  CRISPR gRNA sequence
taatccccaaatatcccagt

SEQ ID NO: 813440 - DNA, 20 bp, Artificial
  CRISPR gRNA sequence
gatgaccaacactataagga

SEQ ID NO: 813441 - DNA, 20 bp, Artificial
  CRISPR gRNA sequence
atgaccaacactataaggaa

SEQ ID NO: 813442 - DNA, 20 bp, Artificial
  CRISPR gRNA sequence
taaggaacaaatctctccac

SEQ ID NO: 813443 - DNA, 20 bp, Artificial
  CRISPR gRNA sequence
tccacaactgagaaatccct

SEQ ID NO: 813444 - DNA, 20 bp, Artificial
  CRISPR gRNA sequence
cacaactgagaaatccctga

SEQ ID NO: 813445 - DNA, 20 bp, Artificial
  CRISPR gRNA sequence
agaaatccctgatctaggta

SEQ ID NO: 813446 - DNA, 20 bp, Artificial
  CRISPR gRNA sequence
atctaggtaaggagtaggca

SEQ ID NO: 813447 - DNA, 20 bp, Artificial
  CRISPR gRNA sequence
ggtaaggagtaggcagggtg

SEQ ID NO: 813448 - DNA, 20 bp, Artificial
  CRISPR gRNA sequence
cccaggaatgagagacagtt

SEQ ID NO: 813449 - DNA, 20 bp, Artificial
  CRISPR gRNA sequence
tcagtttgagagaatgggca

SEQ ID NO: 813450 - DNA, 20 bp, Artificial
  CRISPR gRNA sequence
agtttgagagaatgggcaga

SEQ ID NO: 813451 - DNA, 20 bp, Artificial
  CRISPR gRNA sequence
gagagaatgggcagaaggcc

SEQ ID NO: 813452 - DNA, 20 bp, Artificial
  CRISPR gRNA sequence
agagaatgggcagaaggcct

SEQ ID NO: 813453 - DNA, 20 bp, Artificial
  CRISPR gRNA sequence
gcccattaatacagcattca

SEQ ID NO: 813454 - DNA, 20 bp, Artificial
  CRISPR gRNA sequence
atacagcattcagatagaga

SEQ ID NO: 813455 - DNA, 20 bp, Artificial
  CRISPR gRNA sequence
agatagagatcaataaaaac

SEQ ID NO: 813456 - DNA, 20 bp, Artificial
  CRISPR gRNA sequence
agggttgcagatattcgagt

SEQ ID NO: 813457 - DNA, 20 bp, Artificial
  CRISPR gRNA sequence
gggttgcagatattcgagta

SEQ ID NO: 813458 - DNA, 20 bp, Artificial
  CRISPR gRNA sequence
cagatattcgagtacatcaa

SEQ ID NO: 813459 - DNA, 20 bp, Artificial
  CRISPR gRNA sequence
gagtacatcaaggcatcctg

SEQ ID NO: 813460 - DNA, 20 bp, Artificial
  CRISPR gRNA sequence
agaatgtacagccttacatt

SEQ ID NO: 813461 - DNA, 20 bp, Artificial
  CRISPR gRNA sequence
acattaagggaactcagaca

SEQ ID NO: 813462 - DNA, 20 bp, Artificial
  CRISPR gRNA sequence
cattaagggaactcagacaa

SEQ ID NO: 813463 - DNA, 20 bp, Artificial
  CRISPR gRNA sequence
agggaactcagacaaacttc

SEQ ID NO: 813464 - DNA, 20 bp, Artificial
  CRISPR gRNA sequence
agacaaacttcagtgttcta

SEQ ID NO: 813465 - DNA, 20 bp, Artificial
  CRISPR gRNA sequence
cagtgttctagagttcctcc

SEQ ID NO: 813466 - DNA, 20 bp, Artificial
  CRISPR gRNA sequence
agtgttctagagttcctccc

SEQ ID NO: 813467 - DNA, 20 bp, Artificial
  CRISPR gRNA sequence
tagagttcctcccagctgct

SEQ ID NO: 813468 - DNA, 20 bp, Artificial
  CRISPR gRNA sequence
gagttcctcccagctgctgc

SEQ ID NO: 813469 - DNA, 20 bp, Artificial
  CRISPR gRNA sequence
ctcccagctgctgcctggat

SEQ ID NO: 813470 - DNA, 20 bp, Artificial
  CRISPR gRNA sequence
ccagctgctgcctggatgta

SEQ ID NO: 813471 - DNA, 20 bp, Artificial
  CRISPR gRNA sequence
ctgcctggatgtaggaaatg

SEQ ID NO: 813472 - DNA, 20 bp, Artificial
  CRISPR gRNA sequence
cctggatgtaggaaatgcaa

SEQ ID NO: 813473 - DNA, 20 bp, Artificial
  CRISPR gRNA sequence
gatgtaggaaatgcaataaa

SEQ ID NO: 813474 - DNA, 20 bp, Artificial
  CRISPR gRNA sequence
catctaggctaatggctttc

SEQ ID NO: 813475 - DNA, 20 bp, Artificial
  CRISPR gRNA sequence
ggctaatggctttcctggtg

SEQ ID NO: 813476 - DNA, 20 bp, Artificial
  CRISPR gRNA sequence
atggctttcctggtgactca

SEQ ID NO: 813477 - DNA, 20 bp, Artificial
  CRISPR gRNA sequence
tcctggtgactcattgatgg

SEQ ID NO: 813478 - DNA, 20 bp, Artificial
  CRISPR gRNA sequence
cctggtgactcattgatggt

SEQ ID NO: 813479 - DNA, 20 bp, Artificial
  CRISPR gRNA sequence
ctggtgactcattgatggtt

SEQ ID NO: 813480 - DNA, 20 bp, Artificial
  CRISPR gRNA sequence
gtgactcattgatggttgag

SEQ ID NO: 813481 - DNA, 20 bp, Artificial
  CRISPR gRNA sequence
attgatggttgaggtgtgag

SEQ ID NO: 813482 - DNA, 20 bp, Artificial
  CRISPR gRNA sequence
atggttgaggtgtgaggagg

SEQ ID NO: 813483 - DNA, 20 bp, Artificial
  CRISPR gRNA sequence
aggtgtgaggaggtcactgc

SEQ ID NO: 813484 - DNA, 20 bp, Artificial
  CRISPR gRNA sequence
cccctgtaacaactgagggt

SEQ ID NO: 813485 - DNA, 20 bp, Artificial
  CRISPR gRNA sequence
taacaactgagggtctttta

SEQ ID NO: 813486 - DNA, 20 bp, Artificial
  CRISPR gRNA sequence
agggtcttttaaccaagtct

SEQ ID NO: 813487 - DNA, 20 bp, Artificial
  CRISPR gRNA sequence
ttaaccaagtctctggacac

SEQ ID NO: 813488 - DNA, 20 bp, Artificial
  CRISPR gRNA sequence
taaccaagtctctggacact

SEQ ID NO: 813489 - DNA, 20 bp, Artificial
  CRISPR gRNA sequence
aaccaagtctctggacactt

SEQ ID NO: 813490 - DNA, 20 bp, Artificial
  CRISPR gRNA sequence
accaagtctctggacactta

SEQ ID NO: 813491 - DNA, 20 bp, Artificial
  CRISPR gRNA sequence
tggacacttattatatgccg

SEQ ID NO: 813492 - DNA, 20 bp, Artificial
  CRISPR gRNA sequence
gacacttattatatgccggg

SEQ ID NO: 813493 - DNA, 20 bp, Artificial
  CRISPR gRNA sequence
attatatgccgggtaccatg

SEQ ID NO: 813494 - DNA, 20 bp, Artificial
  CRISPR gRNA sequence
ttatatgccgggtaccatgc

SEQ ID NO: 813495 - DNA, 20 bp, Artificial
  CRISPR gRNA sequence
tatgccgggtaccatgctca

SEQ ID NO: 813496 - DNA, 20 bp, Artificial
  CRISPR gRNA sequence
agttctttatgttcattatc

SEQ ID NO: 813497 - DNA, 20 bp, Artificial
  CRISPR gRNA sequence
tttatgttcattatctctct

SEQ ID NO: 813498 - DNA, 20 bp, Artificial
  CRISPR gRNA sequence
tatgttcattatctctctca

SEQ ID NO: 813499 - DNA, 20 bp, Artificial
  CRISPR gRNA sequence
atgttcattatctctctcaa

SEQ ID NO: 813500 - DNA, 20 bp, Artificial
  CRISPR gRNA sequence
tgttcattatctctctcaat

SEQ ID NO: 813501 - DNA, 20 bp, Artificial
  CRISPR gRNA sequence
attatctctctcaatgttga

SEQ ID NO: 813502 - DNA, 20 bp, Artificial
  CRISPR gRNA sequence
tctctctcaatgttgacaac

SEQ ID NO: 813503 - DNA, 20 bp, Artificial
  CRISPR gRNA sequence
tctcaatgttgacaacaatc

SEQ ID NO: 813504 - DNA, 20 bp, Artificial
  CRISPR gRNA sequence
tcaatgttgacaacaatcct

SEQ ID NO: 813505 - DNA, 20 bp, Artificial
  CRISPR gRNA sequence
aatgttgacaacaatcctgt

SEQ ID NO: 813506 - DNA, 20 bp, Artificial
  CRISPR gRNA sequence
acaacaatcctgtgtgtttg

SEQ ID NO: 813507 - DNA, 20 bp, Artificial
  CRISPR gRNA sequence
tgtgtttggtactactattg

SEQ ID NO: 813508 - DNA, 20 bp, Artificial
  CRISPR gRNA sequence
ggtactactattgttcgtct

SEQ ID NO: 813509 - DNA, 20 bp, Artificial
  CRISPR gRNA sequence
gtactactattgttcgtctt

SEQ ID NO: 813510 - DNA, 20 bp, Artificial
  CRISPR gRNA sequence
ctattgttcgtcttctacaa

SEQ ID NO: 813511 - DNA, 20 bp, Artificial
  CRISPR gRNA sequence
ttgttcgtcttctacaaata

SEQ ID NO: 813512 - DNA, 20 bp, Artificial
  CRISPR gRNA sequence
ttcgtcttctacaaataagc

SEQ ID NO: 813513 - DNA, 20 bp, Artificial
  CRISPR gRNA sequence
gtcttctacaaataagcaaa

SEQ ID NO: 813514 - DNA, 20 bp, Artificial
  CRISPR gRNA sequence
ctacaaataagcaaaatgtg

SEQ ID NO: 813515 - DNA, 20 bp, Artificial
  CRISPR gRNA sequence
tacaaataagcaaaatgtga

SEQ ID NO: 813516 - DNA, 20 bp, Artificial
  CRISPR gRNA sequence
caaataagcaaaatgtgagg

SEQ ID NO: 813517 - DNA, 20 bp, Artificial
  CRISPR gRNA sequence
tgaaaggcaaaataacctgc

SEQ ID NO: 813518 - DNA, 20 bp, Artificial
  CRISPR gRNA sequence
cccaaggataagggcgaaca

SEQ ID NO: 813519 - DNA, 20 bp, Artificial
  CRISPR gRNA sequence
atcctcatgtccagtccctc

SEQ ID NO: 813520 - DNA, 20 bp, Artificial
  CRISPR gRNA sequence
atgtccagtccctctagttt

SEQ ID NO: 813521 - DNA, 20 bp, Artificial
  CRISPR gRNA sequence
tagtttgtccttctttgtac

SEQ ID NO: 813522 - DNA, 20 bp, Artificial
  CRISPR gRNA sequence
gtttgtccttctttgtacca

SEQ ID NO: 813523 - DNA, 20 bp, Artificial
  CRISPR gRNA sequence
gtccttctttgtaccagatc

SEQ ID NO: 813524 - DNA, 20 bp, Artificial
  CRISPR gRNA sequence
tccttctttgtaccagatca

SEQ ID NO: 813525 - DNA, 20 bp, Artificial
  CRISPR gRNA sequence
ctttgtaccagatcataaag

SEQ ID NO: 813526 - DNA, 20 bp, Artificial
  CRISPR gRNA sequence
tttgtaccagatcataaagt

SEQ ID NO: 813527 - DNA, 20 bp, Artificial
  CRISPR gRNA sequence
tgtaccagatcataaagtca

SEQ ID NO: 813528 - DNA, 20 bp, Artificial
  CRISPR gRNA sequence
gtaccagatcataaagtcac

SEQ ID NO: 813529 - DNA, 20 bp, Artificial
  CRISPR gRNA sequence
taccagatcataaagtcaca

SEQ ID NO: 813530 - DNA, 20 bp, Artificial
  CRISPR gRNA sequence
tctgccaaggttaatggttt

SEQ ID NO: 813531 - DNA, 20 bp, Artificial
  CRISPR gRNA sequence
ctgccaaggttaatggtttt

SEQ ID NO: 813532 - DNA, 20 bp, Artificial
  CRISPR gRNA sequence
tgccaaggttaatggttttt

SEQ ID NO: 813533 - DNA, 20 bp, Artificial
  CRISPR gRNA sequence
ccaaggttaatggttttttg

SEQ ID NO: 813534 - DNA, 20 bp, Artificial
  CRISPR gRNA sequence
atggttttttggggccaaaa

SEQ ID NO: 813535 - DNA, 20 bp, Artificial
  CRISPR gRNA sequence
tttggggccaaaacccacaa

SEQ ID NO: 813536 - DNA, 20 bp, Artificial
  CRISPR gRNA sequence
ttggggccaaaacccacaaa

SEQ ID NO: 813537 - DNA, 20 bp, Artificial
  CRISPR gRNA sequence
tggggccaaaacccacaaac

SEQ ID NO: 813538 - DNA, 20 bp, Artificial
  CRISPR gRNA sequence
ggggccaaaacccacaaacc

SEQ ID NO: 813539 - DNA, 20 bp, Artificial
  CRISPR gRNA sequence
gggccaaaacccacaaaccc

SEQ ID NO: 813540 - DNA, 20 bp, Artificial
  CRISPR gRNA sequence
tagaagacagtacagaccat

SEQ ID NO: 813541 - DNA, 20 bp, Artificial
  CRISPR gRNA sequence
gaagacagtacagaccatct

SEQ ID NO: 813542 - DNA, 20 bp, Artificial
  CRISPR gRNA sequence
aggtccaatgcgtgggaggg

SEQ ID NO: 813543 - DNA, 20 bp, Artificial
  CRISPR gRNA sequence
gcatcatttatctcagagca

SEQ ID NO: 813544 - DNA, 20 bp, Artificial
  CRISPR gRNA sequence
atctcagagcattcaagcct

SEQ ID NO: 813545 - DNA, 20 bp, Artificial
  CRISPR gRNA sequence
tctcagagcattcaagcctg

SEQ ID NO: 813546 - DNA, 20 bp, Artificial
  CRISPR gRNA sequence
agagcattcaagcctggaga

SEQ ID NO: 813547 - DNA, 20 bp, Artificial
  CRISPR gRNA sequence
aagcctggagaccataagcc

SEQ ID NO: 813548 - DNA, 20 bp, Artificial
  CRISPR gRNA sequence
gagaccataagccaatgaac

SEQ ID NO: 813549 - DNA, 20 bp, Artificial
  CRISPR gRNA sequence
ttttttatagttgttatatg

SEQ ID NO: 813550 - DNA, 20 bp, Artificial
  CRISPR gRNA sequence
tttatagttgttatatgtct

SEQ ID NO: 813551 - DNA, 20 bp, Artificial
  CRISPR gRNA sequence
ttatagttgttatatgtctt

SEQ ID NO: 813552 - DNA, 20 bp, Artificial
  CRISPR gRNA sequence
tatagttgttatatgtcttt

SEQ ID NO: 813553 - DNA, 20 bp, Artificial
  CRISPR gRNA sequence
atagttgttatatgtctttc

SEQ ID NO: 813554 - DNA, 20 bp, Artificial
  CRISPR gRNA sequence
tagttgttatatgtctttcc

SEQ ID NO: 813555 - DNA, 20 bp, Artificial
  CRISPR gRNA sequence
ttatatgtctttcctcaaat

SEQ ID NO: 813556 - DNA, 20 bp, Artificial
  CRISPR gRNA sequence
tatgtctttcctcaaatcac

SEQ ID NO: 813557 - DNA, 20 bp, Artificial
  CRISPR gRNA sequence
tcctcaaatcaccttttcta

SEQ ID NO: 813558 - DNA, 20 bp, Artificial
  CRISPR gRNA sequence
cctcaaatcaccttttctag

SEQ ID NO: 813559 - DNA, 20 bp, Artificial
  CRISPR gRNA sequence
ctcaaatcaccttttctaga

SEQ ID NO: 813560 - DNA, 20 bp, Artificial
  CRISPR gRNA sequence
aaatcaccttttctagaaca

SEQ ID NO: 813561 - DNA, 20 bp, Artificial
  CRISPR gRNA sequence
ttctagaacaaacaagagtg

SEQ ID NO: 813562 - DNA, 20 bp, Artificial
  CRISPR gRNA sequence
tctagaacaaacaagagtgt

SEQ ID NO: 813563 - DNA, 20 bp, Artificial
  CRISPR gRNA sequence
ctagaacaaacaagagtgtg

SEQ ID NO: 813564 - DNA, 20 bp, Artificial
  CRISPR gRNA sequence
tagaacaaacaagagtgtga

SEQ ID NO: 813565 - DNA, 20 bp, Artificial
  CRISPR gRNA sequence
gaacaaacaagagtgtgaag

SEQ ID NO: 813566 - DNA, 20 bp, Artificial
  CRISPR gRNA sequence
tctttatatttagattttca

SEQ ID NO: 813567 - DNA, 20 bp, Artificial
  CRISPR gRNA sequence
tttatatttagattttcaat

SEQ ID NO: 813568 - DNA, 20 bp, Artificial
  CRISPR gRNA sequence
tatatttagattttcaattg

SEQ ID NO: 813569 - DNA, 20 bp, Artificial
  CRISPR gRNA sequence
atatttagattttcaattgt

SEQ ID NO: 813570 - DNA, 20 bp, Artificial
  CRISPR gRNA sequence
tatttagattttcaattgtg

SEQ ID NO: 813571 - DNA, 20 bp, Artificial
  CRISPR gRNA sequence
agattttcaattgtgctgga

SEQ ID NO: 813572 - DNA, 20 bp, Artificial
  CRISPR gRNA sequence
gattttcaattgtgctggag

SEQ ID NO: 813573 - DNA, 20 bp, Artificial
  CRISPR gRNA sequence
tcaattgtgctggagtggag

SEQ ID NO: 813574 - DNA, 20 bp, Artificial
  CRISPR gRNA sequence
caattgtgctggagtggaga

SEQ ID NO: 813575 - DNA, 20 bp, Artificial
  CRISPR gRNA sequence
aattgtgctggagtggagag

SEQ ID NO: 813576 - DNA, 20 bp, Artificial
  CRISPR gRNA sequence
tgctggagtggagagatccc

SEQ ID NO: 813577 - DNA, 20 bp, Artificial
  CRISPR gRNA sequence
gagtggagagatccctgaat

SEQ ID NO: 813578 - DNA, 20 bp, Artificial
  CRISPR gRNA sequence
aatccagaggaatagggaca

SEQ ID NO: 813579 - DNA, 20 bp, Artificial
  CRISPR gRNA sequence
tagacttcatgggactctct

SEQ ID NO: 813580 - DNA, 20 bp, Artificial
  CRISPR gRNA sequence
catgggactctcttgggcta

SEQ ID NO: 813581 - DNA, 20 bp, Artificial
  CRISPR gRNA sequence
atgggactctcttgggctac

SEQ ID NO: 813582 - DNA, 20 bp, Artificial
  CRISPR gRNA sequence
tcttgggctacccacttccc

SEQ ID NO: 813583 - DNA, 20 bp, Artificial
  CRISPR gRNA sequence
ttgggctacccacttccctt

SEQ ID NO: 813584 - DNA, 20 bp, Artificial
  CRISPR gRNA sequence
gggctacccacttcccttct

SEQ ID NO: 813585 - DNA, 20 bp, Artificial
  CRISPR gRNA sequence
ggctacccacttcccttctc

SEQ ID NO: 813586 - DNA, 20 bp, Artificial
  CRISPR gRNA sequence
cccacttcccttctctggat

SEQ ID NO: 813587 - DNA, 20 bp, Artificial
  CRISPR gRNA sequence
cccttctctggatctcagct

SEQ ID NO: 813588 - DNA, 20 bp, Artificial
  CRISPR gRNA sequence
ccttctctggatctcagcta

SEQ ID NO: 813589 - DNA, 20 bp, Artificial
  CRISPR gRNA sequence
ctctggatctcagctacttc

SEQ ID NO: 813590 - DNA, 20 bp, Artificial
  CRISPR gRNA sequence
tctggatctcagctacttca

SEQ ID NO: 813591 - DNA, 20 bp, Artificial
  CRISPR gRNA sequence
tggatctcagctacttcatc

SEQ ID NO: 813592 - DNA, 20 bp, Artificial
  CRISPR gRNA sequence
gatctcagctacttcatctg

SEQ ID NO: 813593 - DNA, 20 bp, Artificial
  CRISPR gRNA sequence
agctacttcatctgcaataa

SEQ ID NO: 813594 - DNA, 20 bp, Artificial
  CRISPR gRNA sequence
cttcatctgcaataaatagg

SEQ ID NO: 813595 - DNA, 20 bp, Artificial
  CRISPR gRNA sequence
catctgcaataaatagggct

SEQ ID NO: 813596 - DNA, 20 bp, Artificial
  CRISPR gRNA sequence
atctgcaataaatagggctt

SEQ ID NO: 813597 - DNA, 20 bp, Artificial
  CRISPR gRNA sequence
caataaatagggcttgcatt

SEQ ID NO: 813598 - DNA, 20 bp, Artificial
  CRISPR gRNA sequence
gcatttgagcagtgttttcc

SEQ ID NO: 813599 - DNA, 20 bp, Artificial
  CRISPR gRNA sequence
catttgagcagtgttttcca

SEQ ID NO: 813600 - DNA, 20 bp, Artificial
  CRISPR gRNA sequence
gagcagtgttttccaaactt

SEQ ID NO: 813601 - DNA, 20 bp, Artificial
  CRISPR gRNA sequence
agcagtgttttccaaacttg

SEQ ID NO: 813602 - DNA, 20 bp, Artificial
  CRISPR gRNA sequence
tccaaacttgtaacttttta

SEQ ID NO: 813603 - DNA, 20 bp, Artificial
  CRISPR gRNA sequence
ccaaacttgtaactttttat

SEQ ID NO: 813604 - DNA, 20 bp, Artificial
  CRISPR gRNA sequence
caaacttgtaactttttatg

SEQ ID NO: 813605 - DNA, 20 bp, Artificial
  CRISPR gRNA sequence
gtaactttttatgatccaaa

SEQ ID NO: 813606 - DNA, 20 bp, Artificial
  CRISPR gRNA sequence
taactttttatgatccaaag

SEQ ID NO: 813607 - DNA, 20 bp, Artificial
  CRISPR gRNA sequence
tttatgatccaaagtaagaa

SEQ ID NO: 813608 - DNA, 20 bp, Artificial
  CRISPR gRNA sequence
ttatgatccaaagtaagaaa

SEQ ID NO: 813609 - DNA, 20 bp, Artificial
  CRISPR gRNA sequence
tatgatccaaagtaagaaaa

SEQ ID NO: 813610 - DNA, 20 bp, Artificial
  CRISPR gRNA sequence
atgatccaaagtaagaaaaa

SEQ ID NO: 813611 - DNA, 20 bp, Artificial
  CRISPR gRNA sequence
tgatccaaagtaagaaaaaa

SEQ ID NO: 813612 - DNA, 20 bp, Artificial
  CRISPR gRNA sequence
ataccatgacccaacacgca

SEQ ID NO: 813613 - DNA, 20 bp, Artificial
  CRISPR gRNA sequence
taccatgacccaacacgcac

SEQ ID NO: 813614 - DNA, 20 bp, Artificial
  CRISPR gRNA sequence
agaaattagttttacagtac

SEQ ID NO: 813615 - DNA, 20 bp, Artificial
  CRISPR gRNA sequence
gttttacagtactcagtcct

SEQ ID NO: 813616 - DNA, 20 bp, Artificial
  CRISPR gRNA sequence
tacagtactcagtcctactc

SEQ ID NO: 813617 - DNA, 20 bp, Artificial
  CRISPR gRNA sequence
acagtactcagtcctactct

SEQ ID NO: 813618 - DNA, 20 bp, Artificial
  CRISPR gRNA sequence
cagtactcagtcctactctg

SEQ ID NO: 813619 - DNA, 20 bp, Artificial
  CRISPR gRNA sequence
agtcctactctgtgatgtcg

SEQ ID NO: 813620 - DNA, 20 bp, Artificial
  CRISPR gRNA sequence
ctctgtgatgtcgtctgatc

SEQ ID NO: 813621 - DNA, 20 bp, Artificial
  CRISPR gRNA sequence
tgtgatgtcgtctgatctac

SEQ ID NO: 813622 - DNA, 20 bp, Artificial
  CRISPR gRNA sequence
tgatgtcgtctgatctactc

SEQ ID NO: 813623 - DNA, 20 bp, Artificial
  CRISPR gRNA sequence
atctactctgtctattctct

SEQ ID NO: 813624 - DNA, 20 bp, Artificial
  CRISPR gRNA sequence
ctctgtctattctcttctat

SEQ ID NO: 813625 - DNA, 20 bp, Artificial
  CRISPR gRNA sequence
tgtctattctcttctataca

SEQ ID NO: 813626 - DNA, 20 bp, Artificial
  CRISPR gRNA sequence
tctattctcttctatacatt

SEQ ID NO: 813627 - DNA, 20 bp, Artificial
  CRISPR gRNA sequence
ttctcttctatacattattt

SEQ ID NO: 813628 - DNA, 20 bp, Artificial
  CRISPR gRNA sequence
tcttctatacattatttttt

SEQ ID NO: 813629 - DNA, 20 bp, Artificial
  CRISPR gRNA sequence
ttctatacattattttttaa

SEQ ID NO: 813630 - DNA, 20 bp, Artificial
  CRISPR gRNA sequence
ctatacattattttttaaag

SEQ ID NO: 813631 - DNA, 20 bp, Artificial
  CRISPR gRNA sequence
tatacattattttttaaagg

SEQ ID NO: 813632 - DNA, 20 bp, Artificial
  CRISPR gRNA sequence
tacattattttttaaagggc

SEQ ID NO: 813633 - DNA, 20 bp, Artificial
  CRISPR gRNA sequence
ttttttaaagggcgggaaac

SEQ ID NO: 813634 - DNA, 20 bp, Artificial
  CRISPR gRNA sequence
tttaaagggcgggaaacgtg

SEQ ID NO: 813635 - DNA, 20 bp, Artificial
  CRISPR gRNA sequence
ttaaagggcgggaaacgtgc

SEQ ID NO: 813636 - DNA, 20 bp, Artificial
  CRISPR gRNA sequence
taaagggcgggaaacgtgca

SEQ ID NO: 813637 - DNA, 20 bp, Artificial
  CRISPR gRNA sequence
aaagggcgggaaacgtgcat

SEQ ID NO: 813638 - DNA, 20 bp, Artificial
  CRISPR gRNA sequence
aagggcgggaaacgtgcatc

SEQ ID NO: 813639 - DNA, 20 bp, Artificial
  CRISPR gRNA sequence
gttgctactcactaaattga

SEQ ID NO: 813640 - DNA, 20 bp, Artificial
  CRISPR gRNA sequence
ctactcactaaattgatatt

SEQ ID NO: 813641 - DNA, 20 bp, Artificial
  CRISPR gRNA sequence
ctcactaaattgatatttta

SEQ ID NO: 813642 - DNA, 20 bp, Artificial
  CRISPR gRNA sequence
actaaattgatattttaatc

SEQ ID NO: 813643 - DNA, 20 bp, Artificial
  CRISPR gRNA sequence
aattgatattttaatccatg

SEQ ID NO: 813644 - DNA, 20 bp, Artificial
  CRISPR gRNA sequence
atattttaatccatgaatgg

SEQ ID NO: 813645 - DNA, 20 bp, Artificial
  CRISPR gRNA sequence
taatccatgaatgggcggca

SEQ ID NO: 813646 - DNA, 20 bp, Artificial
  CRISPR gRNA sequence
aatccatgaatgggcggcaa

SEQ ID NO: 813647 - DNA, 20 bp, Artificial
  CRISPR gRNA sequence
atccatgaatgggcggcaaa

SEQ ID NO: 813648 - DNA, 20 bp, Artificial
  CRISPR gRNA sequence
taaaaactctggattcaggg

SEQ ID NO: 813649 - DNA, 20 bp, Artificial
  CRISPR gRNA sequence
aaaaactctggattcagggt

SEQ ID NO: 813650 - DNA, 20 bp, Artificial
  CRISPR gRNA sequence
aaaactctggattcagggta

SEQ ID NO: 813651 - DNA, 20 bp, Artificial
  CRISPR gRNA sequence
tggattcagggtataaacta

SEQ ID NO: 813652 - DNA, 20 bp, Artificial
  CRISPR gRNA sequence
gattcagggtataaactatt

SEQ ID NO: 813653 - DNA, 20 bp, Artificial
  CRISPR gRNA sequence
agggtataaactattgaaaa

SEQ ID NO: 813654 - DNA, 20 bp, Artificial
  CRISPR gRNA sequence
ttgaaaaagagtatcttaat

SEQ ID NO: 813655 - DNA, 20 bp, Artificial
  CRISPR gRNA sequence
aaaaagagtatcttaataat

SEQ ID NO: 813656 - DNA, 20 bp, Artificial
  CRISPR gRNA sequence
aataatcaagtcagggatgt

SEQ ID NO: 813657 - DNA, 20 bp, Artificial
  CRISPR gRNA sequence
ataatcaagtcagggatgtt

SEQ ID NO: 813658 - DNA, 20 bp, Artificial
  CRISPR gRNA sequence
catgggagaattgtgaatta

SEQ ID NO: 813659 - DNA, 20 bp, Artificial
  CRISPR gRNA sequence
tgaattaggcaaagcttatt

SEQ ID NO: 813660 - DNA, 20 bp, Artificial
  CRISPR gRNA sequence
ggcaaagcttatttttcata

SEQ ID NO: 813661 - DNA, 20 bp, Artificial
  CRISPR gRNA sequence
atttttcataccctcccaca

SEQ ID NO: 813662 - DNA, 20 bp, Artificial
  CRISPR gRNA sequence
tttttcataccctcccacat

SEQ ID NO: 813663 - DNA, 20 bp, Artificial
  CRISPR gRNA sequence
ttcataccctcccacatttc

SEQ ID NO: 813664 - DNA, 20 bp, Artificial
  CRISPR gRNA sequence
tcataccctcccacatttca

SEQ ID NO: 813665 - DNA, 20 bp, Artificial
  CRISPR gRNA sequence
cataccctcccacatttcag

SEQ ID NO: 813666 - DNA, 20 bp, Artificial
  CRISPR gRNA sequence
ataccctcccacatttcagg

SEQ ID NO: 813667 - DNA, 20 bp, Artificial
  CRISPR gRNA sequence
ccacatttcagggactaatt

SEQ ID NO: 813668 - DNA, 20 bp, Artificial
  CRISPR gRNA sequence
cagggactaattttcctggc

SEQ ID NO: 813669 - DNA, 20 bp, Artificial
  CRISPR gRNA sequence
agggactaattttcctggct

SEQ ID NO: 813670 - DNA, 20 bp, Artificial
  CRISPR gRNA sequence
attttcctggcttcctccag

SEQ ID NO: 813671 - DNA, 20 bp, Artificial
  CRISPR gRNA sequence
tcctggcttcctccagtccc

SEQ ID NO: 813672 - DNA, 20 bp, Artificial
  CRISPR gRNA sequence
cctggcttcctccagtccca

SEQ ID NO: 813673 - DNA, 20 bp, Artificial
  CRISPR gRNA sequence
ctggcttcctccagtcccat

SEQ ID NO: 813674 - DNA, 20 bp, Artificial
  CRISPR gRNA sequence
gcttcctccagtcccatttt

SEQ ID NO: 813675 - DNA, 20 bp, Artificial
  CRISPR gRNA sequence
cctccagtcccattttattc

SEQ ID NO: 813676 - DNA, 20 bp, Artificial
  CRISPR gRNA sequence
ctccagtcccattttattcc

SEQ ID NO: 813677 - DNA, 20 bp, Artificial
  CRISPR gRNA sequence
cagtcccattttattcctat

SEQ ID NO: 813678 - DNA, 20 bp, Artificial
  CRISPR gRNA sequence
tattcctataggtcctaccc

SEQ ID NO: 813679 - DNA, 20 bp, Artificial
  CRISPR gRNA sequence
attcctataggtcctacccc

SEQ ID NO: 813680 - DNA, 20 bp, Artificial
  CRISPR gRNA sequence
ttcctataggtcctaccccc

SEQ ID NO: 813681 - DNA, 20 bp, Artificial
  CRISPR gRNA sequence
ctataggtcctacccccttt

SEQ ID NO: 813682 - DNA, 20 bp, Artificial
  CRISPR gRNA sequence
taggtcctaccccctttcac

SEQ ID NO: 813683 - DNA, 20 bp, Artificial
  CRISPR gRNA sequence
ccccctttcacttgtacttc

SEQ ID NO: 813684 - DNA, 20 bp, Artificial
  CRISPR gRNA sequence
tcacttgtacttcggctgct

SEQ ID NO: 813685 - DNA, 20 bp, Artificial
  CRISPR gRNA sequence
cacttgtacttcggctgctt

SEQ ID NO: 813686 - DNA, 20 bp, Artificial
  CRISPR gRNA sequence
acttgtacttcggctgcttt

SEQ ID NO: 813687 - DNA, 20 bp, Artificial
  CRISPR gRNA sequence
gtacttcggctgctttgtac

SEQ ID NO: 813688 - DNA, 20 bp, Artificial
  CRISPR gRNA sequence
tacttcggctgctttgtact

SEQ ID NO: 813689 - DNA, 20 bp, Artificial
  CRISPR gRNA sequence
cggctgctttgtactcagat

SEQ ID NO: 813690 - DNA, 20 bp, Artificial
  CRISPR gRNA sequence
ggctgctttgtactcagatg

SEQ ID NO: 813691 - DNA, 20 bp, Artificial
  CRISPR gRNA sequence
ctttgtactcagatgtcaaa

SEQ ID NO: 813692 - DNA, 20 bp, Artificial
  CRISPR gRNA sequence
tgtactcagatgtcaaaaat

SEQ ID NO: 813693 - DNA, 20 bp, Artificial
  CRISPR gRNA sequence
gtactcagatgtcaaaaatt

SEQ ID NO: 813694 - DNA, 20 bp, Artificial
  CRISPR gRNA sequence
tactcagatgtcaaaaatta

SEQ ID NO: 813695 - DNA, 20 bp, Artificial
  CRISPR gRNA sequence
agatgtcaaaaattatttcc

SEQ ID NO: 813696 - DNA, 20 bp, Artificial
  CRISPR gRNA sequence
tttccgagcagatgctttca

SEQ ID NO: 813697 - DNA, 20 bp, Artificial
  CRISPR gRNA sequence
ccgagcagatgctttcattt

SEQ ID NO: 813698 - DNA, 20 bp, Artificial
  CRISPR gRNA sequence
cgagcagatgctttcatttt

SEQ ID NO: 813699 - DNA, 20 bp, Artificial
  CRISPR gRNA sequence
tcattttctctgaaatagct

SEQ ID NO: 813700 - DNA, 20 bp, Artificial
  CRISPR gRNA sequence
cattttctctgaaatagctg

SEQ ID NO: 813701 - DNA, 20 bp, Artificial
  CRISPR gRNA sequence
attttctctgaaatagctgt

SEQ ID NO: 813702 - DNA, 20 bp, Artificial
  CRISPR gRNA sequence
tctctgaaatagctgtctcc

SEQ ID NO: 813703 - DNA, 20 bp, Artificial
  CRISPR gRNA sequence
ctctgaaatagctgtctcct

SEQ ID NO: 813704 - DNA, 20 bp, Artificial
  CRISPR gRNA sequence
tctgaaatagctgtctcctt

SEQ ID NO: 813705 - DNA, 20 bp, Artificial
  CRISPR gRNA sequence
tgaaatagctgtctccttaa

SEQ ID NO: 813706 - DNA, 20 bp, Artificial
  CRISPR gRNA sequence
aaatagctgtctccttaaaa

SEQ ID NO: 813707 - DNA, 20 bp, Artificial
  CRISPR gRNA sequence
tctccttaaaagcagcctgc

SEQ ID NO: 813708 - DNA, 20 bp, Artificial
  CRISPR gRNA sequence
cttaaaagcagcctgcttgt

SEQ ID NO: 813709 - DNA, 20 bp, Artificial
  CRISPR gRNA sequence
aaaagcagcctgcttgtttt

SEQ ID NO: 813710 - DNA, 20 bp, Artificial
  CRISPR gRNA sequence
aaagcagcctgcttgttttt

SEQ ID NO: 813711 - DNA, 20 bp, Artificial
  CRISPR gRNA sequence
cttgtttttgcttgagctac

SEQ ID NO: 813712 - DNA, 20 bp, Artificial
  CRISPR gRNA sequence
gtttttgcttgagctacctt

SEQ ID NO: 813713 - DNA, 20 bp, Artificial
  CRISPR gRNA sequence
tttttgcttgagctaccttt

SEQ ID NO: 813714 - DNA, 20 bp, Artificial
  CRISPR gRNA sequence
ttgcttgagctacctttaat

SEQ ID NO: 813715 - DNA, 20 bp, Artificial
  CRISPR gRNA sequence
tgcttgagctacctttaatg

SEQ ID NO: 813716 - DNA, 20 bp, Artificial
  CRISPR gRNA sequence
gcttgagctacctttaatgg

SEQ ID NO: 813717 - DNA, 20 bp, Artificial
  CRISPR gRNA sequence
cttgagctacctttaatggg

SEQ ID NO: 813718 - DNA, 20 bp, Artificial
  CRISPR gRNA sequence
gagctacctttaatgggttt

SEQ ID NO: 813719 - DNA, 20 bp, Artificial
  CRISPR gRNA sequence
agctacctttaatgggtttc

SEQ ID NO: 813720 - DNA, 20 bp, Artificial
  CRISPR gRNA sequence
cctttaatgggtttctgtga

SEQ ID NO: 813721 - DNA, 20 bp, Artificial
  CRISPR gRNA sequence
taatgggtttctgtgacttg

SEQ ID NO: 813722 - DNA, 20 bp, Artificial
  CRISPR gRNA sequence
aatgggtttctgtgacttgc

SEQ ID NO: 813723 - DNA, 20 bp, Artificial
  CRISPR gRNA sequence
atgggtttctgtgacttgca

SEQ ID NO: 813724 - DNA, 20 bp, Artificial
  CRISPR gRNA sequence
ctgtgacttgcagatcctct

SEQ ID NO: 813725 - DNA, 20 bp, Artificial
  CRISPR gRNA sequence
tgtgacttgcagatcctctg

SEQ ID NO: 813726 - DNA, 20 bp, Artificial
  CRISPR gRNA sequence
tgacttgcagatcctctgtt

SEQ ID NO: 813727 - DNA, 20 bp, Artificial
  CRISPR gRNA sequence
gcagatcctctgttggagag

SEQ ID NO: 813728 - DNA, 20 bp, Artificial
  CRISPR gRNA sequence
cagatcctctgttggagaga

SEQ ID NO: 813729 - DNA, 20 bp, Artificial
  CRISPR gRNA sequence
tgttggagagatgcttccat

SEQ ID NO: 813730 - DNA, 20 bp, Artificial
  CRISPR gRNA sequence
ttggagagatgcttccatgg

SEQ ID NO: 813731 - DNA, 20 bp, Artificial
  CRISPR gRNA sequence
gagagatgcttccatggatt

SEQ ID NO: 813732 - DNA, 20 bp, Artificial
  CRISPR gRNA sequence
ccatggattctagtccttga

SEQ ID NO: 813733 - DNA, 20 bp, Artificial
  CRISPR gRNA sequence
catggattctagtccttgac

SEQ ID NO: 813734 - DNA, 20 bp, Artificial
  CRISPR gRNA sequence
tagtccttgacaccactcac

SEQ ID NO: 813735 - DNA, 20 bp, Artificial
  CRISPR gRNA sequence
gtccttgacaccactcacct

SEQ ID NO: 813736 - DNA, 20 bp, Artificial
  CRISPR gRNA sequence
gacaccactcacctttgact

SEQ ID NO: 813737 - DNA, 20 bp, Artificial
  CRISPR gRNA sequence
acaccactcacctttgactt

SEQ ID NO: 813738 - DNA, 20 bp, Artificial
  CRISPR gRNA sequence
acctttgactttcagagtca

SEQ ID NO: 813739 - DNA, 20 bp, Artificial
  CRISPR gRNA sequence
tgactttcagagtcaggtac

SEQ ID NO: 813740 - DNA, 20 bp, Artificial
  CRISPR gRNA sequence
gactttcagagtcaggtact

SEQ ID NO: 813741 - DNA, 20 bp, Artificial
  CRISPR gRNA sequence
actttcagagtcaggtactt

SEQ ID NO: 813742 - DNA, 20 bp, Artificial
  CRISPR gRNA sequence
tcagagtcaggtacttgtag

SEQ ID NO: 813743 - DNA, 20 bp, Artificial
  CRISPR gRNA sequence
cagagtcaggtacttgtagt

SEQ ID NO: 813744 - DNA, 20 bp, Artificial
  CRISPR gRNA sequence
agagtcaggtacttgtagtc

SEQ ID NO: 813745 - DNA, 20 bp, Artificial
  CRISPR gRNA sequence
gtagtcccaggcgaccccat

SEQ ID NO: 813746 - DNA, 20 bp, Artificial
  CRISPR gRNA sequence
tagtcccaggcgaccccata

SEQ ID NO: 813747 - DNA, 20 bp, Artificial
  CRISPR gRNA sequence
tgcattggtactgtccttcg

SEQ ID NO: 813748 - DNA, 20 bp, Artificial
  CRISPR gRNA sequence
gtactgtccttcgtccctca

SEQ ID NO: 813749 - DNA, 20 bp, Artificial
  CRISPR gRNA sequence
tccttcgtccctcacttgga

SEQ ID NO: 813750 - DNA, 20 bp, Artificial
  CRISPR gRNA sequence
cgtccctcacttggacttga

SEQ ID NO: 813751 - DNA, 20 bp, Artificial
  CRISPR gRNA sequence
gtccctcacttggacttgag

SEQ ID NO: 813752 - DNA, 20 bp, Artificial
  CRISPR gRNA sequence
acttggacttgaggtatgtg

SEQ ID NO: 813753 - DNA, 20 bp, Artificial
  CRISPR gRNA sequence
ggacttgaggtatgtggaac

SEQ ID NO: 813754 - DNA, 20 bp, Artificial
  CRISPR gRNA sequence
gacttgaggtatgtggaacg

SEQ ID NO: 813755 - DNA, 20 bp, Artificial
  CRISPR gRNA sequence
gaggtatgtggaacgaggcc

SEQ ID NO: 813756 - DNA, 20 bp, Artificial
  CRISPR gRNA sequence
aggtatgtggaacgaggcct

SEQ ID NO: 813757 - DNA, 20 bp, Artificial
  CRISPR gRNA sequence
ccctaggggcagctgctcct

SEQ ID NO: 813758 - DNA, 20 bp, Artificial
  CRISPR gRNA sequence
cctaggggcagctgctcctc

SEQ ID NO: 813759 - DNA, 20 bp, Artificial
  CRISPR gRNA sequence
ggggcagctgctcctccagc

SEQ ID NO: 813760 - DNA, 20 bp, Artificial
  CRISPR gRNA sequence
ctcctccagcaaagtggctc

SEQ ID NO: 813761 - DNA, 20 bp, Artificial
  CRISPR gRNA sequence
ctccagcaaagtggctcttt

SEQ ID NO: 813762 - DNA, 20 bp, Artificial
  CRISPR gRNA sequence
cagcaaagtggctctttcac

SEQ ID NO: 813763 - DNA, 20 bp, Artificial
  CRISPR gRNA sequence
tttcacggtgtggggatgta

SEQ ID NO: 813764 - DNA, 20 bp, Artificial
  CRISPR gRNA sequence
tcacggtgtggggatgtatc

SEQ ID NO: 813765 - DNA, 20 bp, Artificial
  CRISPR gRNA sequence
cacggtgtggggatgtatca

SEQ ID NO: 813766 - DNA, 20 bp, Artificial
  CRISPR gRNA sequence
acggtgtggggatgtatcat

SEQ ID NO: 813767 - DNA, 20 bp, Artificial
  CRISPR gRNA sequence
tccaccttttgcaaactggc

SEQ ID NO: 813768 - DNA, 20 bp, Artificial
  CRISPR gRNA sequence
ccaccttttgcaaactggct

SEQ ID NO: 813769 - DNA, 20 bp, Artificial
  CRISPR gRNA sequence
caccttttgcaaactggctg

SEQ ID NO: 813770 - DNA, 20 bp, Artificial
  CRISPR gRNA sequence
ttgcaaactggctgttattg

SEQ ID NO: 813771 - DNA, 20 bp, Artificial
  CRISPR gRNA sequence
tgcaaactggctgttattgc

SEQ ID NO: 813772 - DNA, 20 bp, Artificial
  CRISPR gRNA sequence
gcaaactggctgttattgct

SEQ ID NO: 813773 - DNA, 20 bp, Artificial
  CRISPR gRNA sequence
caaactggctgttattgctc

SEQ ID NO: 813774 - DNA, 20 bp, Artificial
  CRISPR gRNA sequence
gctgttattgctccaaggtt

SEQ ID NO: 813775 - DNA, 20 bp, Artificial
  CRISPR gRNA sequence
ttattgctccaaggttcaca

SEQ ID NO: 813776 - DNA, 20 bp, Artificial
  CRISPR gRNA sequence
ttgctccaaggttcacatga

SEQ ID NO: 813777 - DNA, 20 bp, Artificial
  CRISPR gRNA sequence
ctccaaggttcacatgactt

SEQ ID NO: 813778 - DNA, 20 bp, Artificial
  CRISPR gRNA sequence
caaggttcacatgacttcca

SEQ ID NO: 813779 - DNA, 20 bp, Artificial
  CRISPR gRNA sequence
acatgacttccagtgtcaaa

SEQ ID NO: 813780 - DNA, 20 bp, Artificial
  CRISPR gRNA sequence
ccagtgtcaaagttgcattc

SEQ ID NO: 813781 - DNA, 20 bp, Artificial
  CRISPR gRNA sequence
cagtgtcaaagttgcattcc

SEQ ID NO: 813782 - DNA, 20 bp, Artificial
  CRISPR gRNA sequence
cattccagggtcacattgct

SEQ ID NO: 813783 - DNA, 20 bp, Artificial
  CRISPR gRNA sequence
cagggtcacattgctgccat

SEQ ID NO: 813784 - DNA, 20 bp, Artificial
  CRISPR gRNA sequence
ctgccatgctctattatgta

SEQ ID NO: 813785 - DNA, 20 bp, Artificial
  CRISPR gRNA sequence
ccatgctctattatgtacag

SEQ ID NO: 813786 - DNA, 20 bp, Artificial
  CRISPR gRNA sequence
tattatgtacagttccttag

SEQ ID NO: 813787 - DNA, 20 bp, Artificial
  CRISPR gRNA sequence
ttatgtacagttccttaggg

SEQ ID NO: 813788 - DNA, 20 bp, Artificial
  CRISPR gRNA sequence
tgtacagttccttagggact

SEQ ID NO: 813789 - DNA, 20 bp, Artificial
  CRISPR gRNA sequence
cttagggactgtcactgtga

SEQ ID NO: 813790 - DNA, 20 bp, Artificial
  CRISPR gRNA sequence
agggactgtcactgtgaata

SEQ ID NO: 813791 - DNA, 20 bp, Artificial
  CRISPR gRNA sequence
gggactgtcactgtgaataa

SEQ ID NO: 813792 - DNA, 20 bp, Artificial
  CRISPR gRNA sequence
tcactgtgaataaagctgaa

SEQ ID NO: 813793 - DNA, 20 bp, Artificial
  CRISPR gRNA sequence
tgaataaagctgaaaagaaa

SEQ ID NO: 813794 - DNA, 20 bp, Artificial
  CRISPR gRNA sequence
aaaagaaaacaagatatttt

SEQ ID NO: 813795 - DNA, 20 bp, Artificial
  CRISPR gRNA sequence
tgtcattgtctgcctttact

SEQ ID NO: 813796 - DNA, 20 bp, Artificial
  CRISPR gRNA sequence
gtcattgtctgcctttactt

SEQ ID NO: 813797 - DNA, 20 bp, Artificial
  CRISPR gRNA sequence
tcattgtctgcctttacttt

SEQ ID NO: 813798 - DNA, 20 bp, Artificial
  CRISPR gRNA sequence
tctgcctttactttacattc

SEQ ID NO: 813799 - DNA, 20 bp, Artificial
  CRISPR gRNA sequence
cctttactttacattccagt

SEQ ID NO: 813800 - DNA, 20 bp, Artificial
  CRISPR gRNA sequence
tactttacattccagttctt

SEQ ID NO: 813801 - DNA, 20 bp, Artificial
  CRISPR gRNA sequence
actttacattccagttctta

SEQ ID NO: 813802 - DNA, 20 bp, Artificial
  CRISPR gRNA sequence
ctttacattccagttcttac

SEQ ID NO: 813803 - DNA, 20 bp, Artificial
  CRISPR gRNA sequence
tacattccagttcttacgaa

SEQ ID NO: 813804 - DNA, 20 bp, Artificial
  CRISPR gRNA sequence
acattccagttcttacgaag

SEQ ID NO: 813805 - DNA, 20 bp, Artificial
  CRISPR gRNA sequence
cattccagttcttacgaagt

SEQ ID NO: 813806 - DNA, 20 bp, Artificial
  CRISPR gRNA sequence
cagttcttacgaagtgtaac

SEQ ID NO: 813807 - DNA, 20 bp, Artificial
  CRISPR gRNA sequence
ttacgaagtgtaacctgaga

SEQ ID NO: 813808 - DNA, 20 bp, Artificial
  CRISPR gRNA sequence
acgaagtgtaacctgagacc

SEQ ID NO: 813809 - DNA, 20 bp, Artificial
  CRISPR gRNA sequence
cgaagtgtaacctgagaccc

SEQ ID NO: 813810 - DNA, 20 bp, Artificial
  CRISPR gRNA sequence
agacccatctcacccccatt

SEQ ID NO: 813811 - DNA, 20 bp, Artificial
  CRISPR gRNA sequence
acccccattttccaaaaggc

SEQ ID NO: 813812 - DNA, 20 bp, Artificial
  CRISPR gRNA sequence
tccaaaaggcacctgtctta

SEQ ID NO: 813813 - DNA, 20 bp, Artificial
  CRISPR gRNA sequence
ccaaaaggcacctgtcttat

SEQ ID NO: 813814 - DNA, 20 bp, Artificial
  CRISPR gRNA sequence
caaaaggcacctgtcttatc

SEQ ID NO: 813815 - DNA, 20 bp, Artificial
  CRISPR gRNA sequence
tcttatctggacattcccgt

SEQ ID NO: 813816 - DNA, 20 bp, Artificial
  CRISPR gRNA sequence
atctggacattcccgtggcg

SEQ ID NO: 813817 - DNA, 20 bp, Artificial
  CRISPR gRNA sequence
tctggacattcccgtggcga

SEQ ID NO: 813818 - DNA, 20 bp, Artificial
  CRISPR gRNA sequence
gacattcccgtggcgaatcc

SEQ ID NO: 813819 - DNA, 20 bp, Artificial
  CRISPR gRNA sequence
ccgtggcgaatcctttttct

SEQ ID NO: 813820 - DNA, 20 bp, Artificial
  CRISPR gRNA sequence
tttctcctttgccccatcca

SEQ ID NO: 813821 - DNA, 20 bp, Artificial
  CRISPR gRNA sequence
ttctcctttgccccatccat

SEQ ID NO: 813822 - DNA, 20 bp, Artificial
  CRISPR gRNA sequence
tctcctttgccccatccatc

SEQ ID NO: 813823 - DNA, 20 bp, Artificial
  CRISPR gRNA sequence
ctcctttgccccatccatct

SEQ ID NO: 813824 - DNA, 20 bp, Artificial
  CRISPR gRNA sequence
tcctttgccccatccatctg

SEQ ID NO: 813825 - DNA, 20 bp, Artificial
  CRISPR gRNA sequence
ctttgccccatccatctggg

SEQ ID NO: 813826 - DNA, 20 bp, Artificial
  CRISPR gRNA sequence
tgccccatccatctgggcaa

SEQ ID NO: 813827 - DNA, 20 bp, Artificial
  CRISPR gRNA sequence
gccccatccatctgggcaag

SEQ ID NO: 813828 - DNA, 20 bp, Artificial
  CRISPR gRNA sequence
ccccatccatctgggcaaga

SEQ ID NO: 813829 - DNA, 20 bp, Artificial
  CRISPR gRNA sequence
ggcaagagtgggattcttga

SEQ ID NO: 813830 - DNA, 20 bp, Artificial
  CRISPR gRNA sequence
ttgacccgctgatctgaggt

SEQ ID NO: 813831 - DNA, 20 bp, Artificial
  CRISPR gRNA sequence
gacccgctgatctgaggtgg

SEQ ID NO: 813832 - DNA, 20 bp, Artificial
  CRISPR gRNA sequence
acccgctgatctgaggtggc

SEQ ID NO: 813833 - DNA, 20 bp, Artificial
  CRISPR gRNA sequence
atctgaggtggctctctcct

SEQ ID NO: 813834 - DNA, 20 bp, Artificial
  CRISPR gRNA sequence
aggtggctctctcctccaaa

SEQ ID NO: 813835 - DNA, 20 bp, Artificial
  CRISPR gRNA sequence
tctcctccaaacattccctc

SEQ ID NO: 813836 - DNA, 20 bp, Artificial
  CRISPR gRNA sequence
tcctccaaacattccctcct

SEQ ID NO: 813837 - DNA, 20 bp, Artificial
  CRISPR gRNA sequence
ctccaaacattccctcctgt

SEQ ID NO: 813838 - DNA, 20 bp, Artificial
  CRISPR gRNA sequence
caaacattccctcctgtgca

SEQ ID NO: 813839 - DNA, 20 bp, Artificial
  CRISPR gRNA sequence
cctcctgtgcagctgactgc

SEQ ID NO: 813840 - DNA, 20 bp, Artificial
  CRISPR gRNA sequence
ctgtgcagctgactgccctt

SEQ ID NO: 813841 - DNA, 20 bp, Artificial
  CRISPR gRNA sequence
tgcagctgactgccctttgc

SEQ ID NO: 813842 - DNA, 20 bp, Artificial
  CRISPR gRNA sequence
actgccctttgctcctctct

SEQ ID NO: 813843 - DNA, 20 bp, Artificial
  CRISPR gRNA sequence
ccctttgctcctctctgggc

SEQ ID NO: 813844 - DNA, 20 bp, Artificial
  CRISPR gRNA sequence
tgctcctctctgggcacccc

SEQ ID NO: 813845 - DNA, 20 bp, Artificial
  CRISPR gRNA sequence
gctcctctctgggcacccca

SEQ ID NO: 813846 - DNA, 20 bp, Artificial
  CRISPR gRNA sequence
ctcctctctgggcaccccag

SEQ ID NO: 813847 - DNA, 20 bp, Artificial
  CRISPR gRNA sequence
ctctctgggcaccccagcaa

SEQ ID NO: 813848 - DNA, 20 bp, Artificial
  CRISPR gRNA sequence
tctgggcaccccagcaagag

SEQ ID NO: 813849 - DNA, 20 bp, Artificial
  CRISPR gRNA sequence
tgggcaccccagcaagagct

SEQ ID NO: 813850 - DNA, 20 bp, Artificial
  CRISPR gRNA sequence
ggcaccccagcaagagcttc

SEQ ID NO: 813851 - DNA, 20 bp, Artificial
  CRISPR gRNA sequence
ctggtggacagcactgcttg

SEQ ID NO: 813852 - DNA, 20 bp, Artificial
  CRISPR gRNA sequence
tggtggacagcactgcttgc

SEQ ID NO: 813853 - DNA, 20 bp, Artificial
  CRISPR gRNA sequence
gtggacagcactgcttgctc

SEQ ID NO: 813854 - DNA, 20 bp, Artificial
  CRISPR gRNA sequence
cttgctctcagaggcctctc

SEQ ID NO: 813855 - DNA, 20 bp, Artificial
  CRISPR gRNA sequence
gctctcagaggcctctccca

SEQ ID NO: 813856 - DNA, 20 bp, Artificial
  CRISPR gRNA sequence
ctctcagaggcctctcccac

SEQ ID NO: 813857 - DNA, 20 bp, Artificial
  CRISPR gRNA sequence
tcagaggcctctcccacctc

SEQ ID NO: 813858 - DNA, 20 bp, Artificial
  CRISPR gRNA sequence
agaggcctctcccacctcca

SEQ ID NO: 813859 - DNA, 20 bp, Artificial
  CRISPR gRNA sequence
tcccacctccagtccctgac

SEQ ID NO: 813860 - DNA, 20 bp, Artificial
  CRISPR gRNA sequence
ccacctccagtccctgaccc

SEQ ID NO: 813861 - DNA, 20 bp, Artificial
  CRISPR gRNA sequence
cagtccctgaccccccaagc

SEQ ID NO: 813862 - DNA, 20 bp, Artificial
  CRISPR gRNA sequence
accccccaagccctgcagtc

SEQ ID NO: 813863 - DNA, 20 bp, Artificial
  CRISPR gRNA sequence
cagtcattccaggtcatctg

SEQ ID NO: 813864 - DNA, 20 bp, Artificial
  CRISPR gRNA sequence
caggtcatctgtcatataag

SEQ ID NO: 813865 - DNA, 20 bp, Artificial
  CRISPR gRNA sequence
tcatataagaacaaaatgct

SEQ ID NO: 813866 - DNA, 20 bp, Artificial
  CRISPR gRNA sequence
cctttcgacttccctaccat

SEQ ID NO: 813867 - DNA, 20 bp, Artificial
  CRISPR gRNA sequence
ctttcgacttccctaccatc

SEQ ID NO: 813868 - DNA, 20 bp, Artificial
  CRISPR gRNA sequence
tcgacttccctaccatcaag

SEQ ID NO: 813869 - DNA, 20 bp, Artificial
  CRISPR gRNA sequence
cgacttccctaccatcaagg

SEQ ID NO: 813870 - DNA, 20 bp, Artificial
  CRISPR gRNA sequence
gacttccctaccatcaaggt

SEQ ID NO: 813871 - DNA, 20 bp, Artificial
  CRISPR gRNA sequence
ccctaccatcaaggtctgag

SEQ ID NO: 813872 - DNA, 20 bp, Artificial
  CRISPR gRNA sequence
cctaccatcaaggtctgagc

SEQ ID NO: 813873 - DNA, 20 bp, Artificial
  CRISPR gRNA sequence
ccatcaaggtctgagctcat

SEQ ID NO: 813874 - DNA, 20 bp, Artificial
  CRISPR gRNA sequence
agctcatgttacttaaatac

SEQ ID NO: 813875 - DNA, 20 bp, Artificial
  CRISPR gRNA sequence
atgttacttaaataccttca

SEQ ID NO: 813876 - DNA, 20 bp, Artificial
  CRISPR gRNA sequence
cttaaataccttcacatcct

SEQ ID NO: 813877 - DNA, 20 bp, Artificial
  CRISPR gRNA sequence
aaataccttcacatcctatt

SEQ ID NO: 813878 - DNA, 20 bp, Artificial
  CRISPR gRNA sequence
aataccttcacatcctattc

SEQ ID NO: 813879 - DNA, 20 bp, Artificial
  CRISPR gRNA sequence
cacatcctattctccaggtt

SEQ ID NO: 813880 - DNA, 20 bp, Artificial
  CRISPR gRNA sequence
acatcctattctccaggttt

SEQ ID NO: 813881 - DNA, 20 bp, Artificial
  CRISPR gRNA sequence
ttctccaggtttgtttccct

SEQ ID NO: 813882 - DNA, 20 bp, Artificial
  CRISPR gRNA sequence
tccaggtttgtttccctcaa

SEQ ID NO: 813883 - DNA, 20 bp, Artificial
  CRISPR gRNA sequence
caggtttgtttccctcaatc

SEQ ID NO: 813884 - DNA, 20 bp, Artificial
  CRISPR gRNA sequence
gtttccctcaatccatattg

SEQ ID NO: 813885 - DNA, 20 bp, Artificial
  CRISPR gRNA sequence
tttccctcaatccatattga

SEQ ID NO: 813886 - DNA, 20 bp, Artificial
  CRISPR gRNA sequence
ccctcaatccatattgatta

SEQ ID NO: 813887 - DNA, 20 bp, Artificial
  CRISPR gRNA sequence
cctcaatccatattgattaa

SEQ ID NO: 813888 - DNA, 20 bp, Artificial
  CRISPR gRNA sequence
aatccatattgattaatcca

SEQ ID NO: 813889 - DNA, 20 bp, Artificial
  CRISPR gRNA sequence
attaatccatatatttttgt

SEQ ID NO: 813890 - DNA, 20 bp, Artificial
  CRISPR gRNA sequence
atccatatatttttgtgcca

SEQ ID NO: 813891 - DNA, 20 bp, Artificial
  CRISPR gRNA sequence
ttgtgccaggtatcacttcc

SEQ ID NO: 813892 - DNA, 20 bp, Artificial
  CRISPR gRNA sequence
tgtgccaggtatcacttcct

SEQ ID NO: 813893 - DNA, 20 bp, Artificial
  CRISPR gRNA sequence
gtgccaggtatcacttcctc

SEQ ID NO: 813894 - DNA, 20 bp, Artificial
  CRISPR gRNA sequence
tgccaggtatcacttcctct

SEQ ID NO: 813895 - DNA, 20 bp, Artificial
  CRISPR gRNA sequence
cctctcaccagtgatggtaa

SEQ ID NO: 813896 - DNA, 20 bp, Artificial
  CRISPR gRNA sequence
ctctcaccagtgatggtaat

SEQ ID NO: 813897 - DNA, 20 bp, Artificial
  CRISPR gRNA sequence
tcaccagtgatggtaataat

SEQ ID NO: 813898 - DNA, 20 bp, Artificial
  CRISPR gRNA sequence
accagtgatggtaataataa

SEQ ID NO: 813899 - DNA, 20 bp, Artificial
  CRISPR gRNA sequence
ttacttgttgaattcttaca

SEQ ID NO: 813900 - DNA, 20 bp, Artificial
  CRISPR gRNA sequence
cttgttgaattcttacaatt

SEQ ID NO: 813901 - DNA, 20 bp, Artificial
  CRISPR gRNA sequence
gttgaattcttacaattgtc

SEQ ID NO: 813902 - DNA, 20 bp, Artificial
  CRISPR gRNA sequence
ttgaattcttacaattgtca

SEQ ID NO: 813903 - DNA, 20 bp, Artificial
  CRISPR gRNA sequence
aattcttacaattgtcagac

SEQ ID NO: 813904 - DNA, 20 bp, Artificial
  CRISPR gRNA sequence
ttacaattgtcagacactct

SEQ ID NO: 813905 - DNA, 20 bp, Artificial
  CRISPR gRNA sequence
acaattgtcagacactctgc

SEQ ID NO: 813906 - DNA, 20 bp, Artificial
  CRISPR gRNA sequence
caattgtcagacactctgct

SEQ ID NO: 813907 - DNA, 20 bp, Artificial
  CRISPR gRNA sequence
tcagacactctgctaacaca

SEQ ID NO: 813908 - DNA, 20 bp, Artificial
  CRISPR gRNA sequence
tgctaacacatcgtctcact

SEQ ID NO: 813909 - DNA, 20 bp, Artificial
  CRISPR gRNA sequence
ctaacacatcgtctcactga

SEQ ID NO: 813910 - DNA, 20 bp, Artificial
  CRISPR gRNA sequence
acacatcgtctcactgagct

SEQ ID NO: 813911 - DNA, 20 bp, Artificial
  CRISPR gRNA sequence
actgagcttcttcccagaag

SEQ ID NO: 813912 - DNA, 20 bp, Artificial
  CRISPR gRNA sequence
agcttcttcccagaagccag

SEQ ID NO: 813913 - DNA, 20 bp, Artificial
  CRISPR gRNA sequence
cttcccagaagccagcaagg

SEQ ID NO: 813914 - DNA, 20 bp, Artificial
  CRISPR gRNA sequence
ttcccagaagccagcaaggt

SEQ ID NO: 813915 - DNA, 20 bp, Artificial
  CRISPR gRNA sequence
cccagaagccagcaaggtag

SEQ ID NO: 813916 - DNA, 20 bp, Artificial
  CRISPR gRNA sequence
ccagaagccagcaaggtagg

SEQ ID NO: 813917 - DNA, 20 bp, Artificial
  CRISPR gRNA sequence
tatcctttttttcagaaaac

SEQ ID NO: 813918 - DNA, 20 bp, Artificial
  CRISPR gRNA sequence
tcctttttttcagaaaacaa

SEQ ID NO: 813919 - DNA, 20 bp, Artificial
  CRISPR gRNA sequence
tttttcagaaaacaaaaatg

SEQ ID NO: 813920 - DNA, 20 bp, Artificial
  CRISPR gRNA sequence
ttttcagaaaacaaaaatga

SEQ ID NO: 813921 - DNA, 20 bp, Artificial
  CRISPR gRNA sequence
tttcagaaaacaaaaatgag

SEQ ID NO: 813922 - DNA, 20 bp, Artificial
  CRISPR gRNA sequence
ttcagaaaacaaaaatgagg

SEQ ID NO: 813923 - DNA, 20 bp, Artificial
  CRISPR gRNA sequence
tcagaaaacaaaaatgaggc

SEQ ID NO: 813924 - DNA, 20 bp, Artificial
  CRISPR gRNA sequence
cagaaaacaaaaatgaggca

SEQ ID NO: 813925 - DNA, 20 bp, Artificial
  CRISPR gRNA sequence
agaaaacaaaaatgaggcac

SEQ ID NO: 813926 - DNA, 20 bp, Artificial
  CRISPR gRNA sequence
agtaacttgcccaagattgc

SEQ ID NO: 813927 - DNA, 20 bp, Artificial
  CRISPR gRNA sequence
gcccaagattgcacagccag

SEQ ID NO: 813928 - DNA, 20 bp, Artificial
  CRISPR gRNA sequence
cccaagattgcacagccaga

SEQ ID NO: 813929 - DNA, 20 bp, Artificial
  CRISPR gRNA sequence
cacagccagaatcagatcag

SEQ ID NO: 813930 - DNA, 20 bp, Artificial
  CRISPR gRNA sequence
ctaaccaccacatcatacaa

SEQ ID NO: 813931 - DNA, 20 bp, Artificial
  CRISPR gRNA sequence
taaccaccacatcatacaag

SEQ ID NO: 813932 - DNA, 20 bp, Artificial
  CRISPR gRNA sequence
accaccacatcatacaagcc

SEQ ID NO: 813933 - DNA, 20 bp, Artificial
  CRISPR gRNA sequence
tagatgctttctattttctg

SEQ ID NO: 813934 - DNA, 20 bp, Artificial
  CRISPR gRNA sequence
tctattttctgacaataaag

SEQ ID NO: 813935 - DNA, 20 bp, Artificial
  CRISPR gRNA sequence
ctattttctgacaataaagg

SEQ ID NO: 813936 - DNA, 20 bp, Artificial
  CRISPR gRNA sequence
tattttctgacaataaaggg

SEQ ID NO: 813937 - DNA, 20 bp, Artificial
  CRISPR gRNA sequence
ttttctgacaataaagggaa

SEQ ID NO: 813938 - DNA, 20 bp, Artificial
  CRISPR gRNA sequence
tctgacaataaagggaaagg

SEQ ID NO: 813939 - DNA, 20 bp, Artificial
  CRISPR gRNA sequence
ctgacaataaagggaaagga

SEQ ID NO: 813940 - DNA, 20 bp, Artificial
  CRISPR gRNA sequence
tgacaataaagggaaaggaa

SEQ ID NO: 813941 - DNA, 20 bp, Artificial
  CRISPR gRNA sequence
acaataaagggaaaggaaaa

SEQ ID NO: 813942 - DNA, 20 bp, Artificial
  CRISPR gRNA sequence
atacttaatgtatatctagt

SEQ ID NO: 813943 - DNA, 20 bp, Artificial
  CRISPR gRNA sequence
aatgtatatctagtatgttc

SEQ ID NO: 813944 - DNA, 20 bp, Artificial
  CRISPR gRNA sequence
atgtatatctagtatgttct

SEQ ID NO: 813945 - DNA, 20 bp, Artificial
  CRISPR gRNA sequence
gtatgttctatgccaggcac

SEQ ID NO: 813946 - DNA, 20 bp, Artificial
  CRISPR gRNA sequence
tatgccaggcactgtgctag

SEQ ID NO: 813947 - DNA, 20 bp, Artificial
  CRISPR gRNA sequence
tgccaggcactgtgctaggt

SEQ ID NO: 813948 - DNA, 20 bp, Artificial
  CRISPR gRNA sequence
tgctaggtacttttaactat

SEQ ID NO: 813949 - DNA, 20 bp, Artificial
  CRISPR gRNA sequence
ggtacttttaactatattgt

SEQ ID NO: 813950 - DNA, 20 bp, Artificial
  CRISPR gRNA sequence
ttaactatattgtttaatac

SEQ ID NO: 813951 - DNA, 20 bp, Artificial
  CRISPR gRNA sequence
taactatattgtttaatact

SEQ ID NO: 813952 - DNA, 20 bp, Artificial
  CRISPR gRNA sequence
aactatattgtttaatactg

SEQ ID NO: 813953 - DNA, 20 bp, Artificial
  CRISPR gRNA sequence
actatattgtttaatactga

SEQ ID NO: 813954 - DNA, 20 bp, Artificial
  CRISPR gRNA sequence
tattgtttaatactgaaaac

SEQ ID NO: 813955 - DNA, 20 bp, Artificial
  CRISPR gRNA sequence
tttaatactgaaaacatgac

SEQ ID NO: 813956 - DNA, 20 bp, Artificial
  CRISPR gRNA sequence
aatactgaaaacatgaccgt

SEQ ID NO: 813957 - DNA, 20 bp, Artificial
  CRISPR gRNA sequence
atactgaaaacatgaccgtg

SEQ ID NO: 813958 - DNA, 20 bp, Artificial
  CRISPR gRNA sequence
aaaacatgaccgtgaaacct

SEQ ID NO: 813959 - DNA, 20 bp, Artificial
  CRISPR gRNA sequence
ttttgtcattatggttatat

SEQ ID NO: 813960 - DNA, 20 bp, Artificial
  CRISPR gRNA sequence
tgtcattatggttatatagt

SEQ ID NO: 813961 - DNA, 20 bp, Artificial
  CRISPR gRNA sequence
gtcattatggttatatagtt

SEQ ID NO: 813962 - DNA, 20 bp, Artificial
  CRISPR gRNA sequence
tcattatggttatatagttg

SEQ ID NO: 813963 - DNA, 20 bp, Artificial
  CRISPR gRNA sequence
tggttatatagttgaggaaa

SEQ ID NO: 813964 - DNA, 20 bp, Artificial
  CRISPR gRNA sequence
tatagttgaggaaactggct

SEQ ID NO: 813965 - DNA, 20 bp, Artificial
  CRISPR gRNA sequence
aggaaactggctccaagcag

SEQ ID NO: 813966 - DNA, 20 bp, Artificial
  CRISPR gRNA sequence
gctccaagcagttcacttca

SEQ ID NO: 813967 - DNA, 20 bp, Artificial
  CRISPR gRNA sequence
caagcagttcacttcaggac

SEQ ID NO: 813968 - DNA, 20 bp, Artificial
  CRISPR gRNA sequence
acttcaggacatatgttagt

SEQ ID NO: 813969 - DNA, 20 bp, Artificial
  CRISPR gRNA sequence
caggacatatgttagtaaag

SEQ ID NO: 813970 - DNA, 20 bp, Artificial
  CRISPR gRNA sequence
aggacatatgttagtaaagt

SEQ ID NO: 813971 - DNA, 20 bp, Artificial
  CRISPR gRNA sequence
gtaaagttaaaatccagagc

SEQ ID NO: 813972 - DNA, 20 bp, Artificial
  CRISPR gRNA sequence
aaatccagagccagtcagat

SEQ ID NO: 813973 - DNA, 20 bp, Artificial
  CRISPR gRNA sequence
gactacaaaatccgtagttt

SEQ ID NO: 813974 - DNA, 20 bp, Artificial
  CRISPR gRNA sequence
actacaaaatccgtagtttc

SEQ ID NO: 813975 - DNA, 20 bp, Artificial
  CRISPR gRNA sequence
caaaatccgtagtttccact

SEQ ID NO: 813976 - DNA, 20 bp, Artificial
  CRISPR gRNA sequence
ccactcagagtttaccaaaa

SEQ ID NO: 813977 - DNA, 20 bp, Artificial
  CRISPR gRNA sequence
cactcagagtttaccaaaat

SEQ ID NO: 813978 - DNA, 20 bp, Artificial
  CRISPR gRNA sequence
agagtttaccaaaatgtgag

SEQ ID NO: 813979 - DNA, 20 bp, Artificial
  CRISPR gRNA sequence
accaaaatgtgagggacacg

SEQ ID NO: 813980 - DNA, 20 bp, Artificial
  CRISPR gRNA sequence
ccaaaatgtgagggacacgc

SEQ ID NO: 813981 - DNA, 20 bp, Artificial
  CRISPR gRNA sequence
gaagtatgtaagatgatttt

SEQ ID NO: 813982 - DNA, 20 bp, Artificial
  CRISPR gRNA sequence
tagatgaggcagaatcaaag

SEQ ID NO: 813983 - DNA, 20 bp, Artificial
  CRISPR gRNA sequence
agatgaggcagaatcaaagc

SEQ ID NO: 813984 - DNA, 20 bp, Artificial
  CRISPR gRNA sequence
gatgaggcagaatcaaagcc

SEQ ID NO: 813985 - DNA, 20 bp, Artificial
  CRISPR gRNA sequence
aagggagttaaattattcag

SEQ ID NO: 813986 - DNA, 20 bp, Artificial
  CRISPR gRNA sequence
aattattcagagaggaattt

SEQ ID NO: 813987 - DNA, 20 bp, Artificial
  CRISPR gRNA sequence
ttcagagaggaatttattcc

SEQ ID NO: 813988 - DNA, 20 bp, Artificial
  CRISPR gRNA sequence
agagaggaatttattccctt

SEQ ID NO: 813989 - DNA, 20 bp, Artificial
  CRISPR gRNA sequence
attcccttttcaattctatt

SEQ ID NO: 813990 - DNA, 20 bp, Artificial
  CRISPR gRNA sequence
ttcccttttcaattctattt

SEQ ID NO: 813991 - DNA, 20 bp, Artificial
  CRISPR gRNA sequence
ccttttcaattctattttaa

SEQ ID NO: 813992 - DNA, 20 bp, Artificial
  CRISPR gRNA sequence
ttcaattctattttaatcct

SEQ ID NO: 813993 - DNA, 20 bp, Artificial
  CRISPR gRNA sequence
tcaattctattttaatcctt

SEQ ID NO: 813994 - DNA, 20 bp, Artificial
  CRISPR gRNA sequence
caattctattttaatccttc

SEQ ID NO: 813995 - DNA, 20 bp, Artificial
  CRISPR gRNA sequence
aattctattttaatccttca

SEQ ID NO: 813996 - DNA, 20 bp, Artificial
  CRISPR gRNA sequence
tattttaatccttcaattgc

SEQ ID NO: 813997 - DNA, 20 bp, Artificial
  CRISPR gRNA sequence
ttttaatccttcaattgcat

SEQ ID NO: 813998 - DNA, 20 bp, Artificial
  CRISPR gRNA sequence
taatccttcaattgcatata

SEQ ID NO: 813999 - DNA, 20 bp, Artificial
  CRISPR gRNA sequence
aatccttcaattgcatataa

SEQ ID NO: 814000 - DNA, 20 bp, Artificial
  CRISPR gRNA sequence
atccttcaattgcatataat

SEQ ID NO: 814001 - DNA, 20 bp, Artificial
  CRISPR gRNA sequence
caattgcatataatttcaac

SEQ ID NO: 814002 - DNA, 20 bp, Artificial
  CRISPR gRNA sequence
aattgcatataatttcaact

SEQ ID NO: 814003 - DNA, 20 bp, Artificial
  CRISPR gRNA sequence
catataatttcaactagact

SEQ ID NO: 814004 - DNA, 20 bp, Artificial
  CRISPR gRNA sequence
caactagacttccacacctc

SEQ ID NO: 814005 - DNA, 20 bp, Artificial
  CRISPR gRNA sequence
aactagacttccacacctct

SEQ ID NO: 814006 - DNA, 20 bp, Artificial
  CRISPR gRNA sequence
gacttccacacctctaacac

SEQ ID NO: 814007 - DNA, 20 bp, Artificial
  CRISPR gRNA sequence
ccacacctctaacactggct

SEQ ID NO: 814008 - DNA, 20 bp, Artificial
  CRISPR gRNA sequence
cacacctctaacactggcta

SEQ ID NO: 814009 - DNA, 20 bp, Artificial
  CRISPR gRNA sequence
taacactggctatttttcct

SEQ ID NO: 814010 - DNA, 20 bp, Artificial
  CRISPR gRNA sequence
acactggctatttttccttt

SEQ ID NO: 814011 - DNA, 20 bp, Artificial
  CRISPR gRNA sequence
gctatttttccttttaatca

SEQ ID NO: 814012 - DNA, 20 bp, Artificial
  CRISPR gRNA sequence
tttttccttttaatcaaaca

SEQ ID NO: 814013 - DNA, 20 bp, Artificial
  CRISPR gRNA sequence
ttccttttaatcaaacagga

SEQ ID NO: 814014 - DNA, 20 bp, Artificial
  CRISPR gRNA sequence
tccttttaatcaaacaggaa

SEQ ID NO: 814015 - DNA, 20 bp, Artificial
  CRISPR gRNA sequence
ccttttaatcaaacaggaag

SEQ ID NO: 814016 - DNA, 20 bp, Artificial
  CRISPR gRNA sequence
cttttaatcaaacaggaagc

SEQ ID NO: 814017 - DNA, 20 bp, Artificial
  CRISPR gRNA sequence
ttaatcaaacaggaagcttc

SEQ ID NO: 814018 - DNA, 20 bp, Artificial
  CRISPR gRNA sequence
taatcaaacaggaagcttcc

SEQ ID NO: 814019 - DNA, 20 bp, Artificial
  CRISPR gRNA sequence
aatcaaacaggaagcttccg

SEQ ID NO: 814020 - DNA, 20 bp, Artificial
  CRISPR gRNA sequence
atcaaacaggaagcttccgg

SEQ ID NO: 814021 - DNA, 20 bp, Artificial
  CRISPR gRNA sequence
ccgggtagataacagtatct

SEQ ID NO: 814022 - DNA, 20 bp, Artificial
  CRISPR gRNA sequence
cgggtagataacagtatctg

SEQ ID NO: 814023 - DNA, 20 bp, Artificial
  CRISPR gRNA sequence
ggtaggatttgataacactg

SEQ ID NO: 814024 - DNA, 20 bp, Artificial
  CRISPR gRNA sequence
gataacactgctttattttc

SEQ ID NO: 814025 - DNA, 20 bp, Artificial
  CRISPR gRNA sequence
ataacactgctttattttca

SEQ ID NO: 814026 - DNA, 20 bp, Artificial
  CRISPR gRNA sequence
ctttattttcactgcattta

SEQ ID NO: 814027 - DNA, 20 bp, Artificial
  CRISPR gRNA sequence
tattttcactgcatttattt

SEQ ID NO: 814028 - DNA, 20 bp, Artificial
  CRISPR gRNA sequence
attttcactgcatttatttt

SEQ ID NO: 814029 - DNA, 20 bp, Artificial
  CRISPR gRNA sequence
ttttcactgcatttattttt

SEQ ID NO: 814030 - DNA, 20 bp, Artificial
  CRISPR gRNA sequence
tcactgcatttatttttctt

SEQ ID NO: 814031 - DNA, 20 bp, Artificial
  CRISPR gRNA sequence
cactgcatttatttttcttc

SEQ ID NO: 814032 - DNA, 20 bp, Artificial
  CRISPR gRNA sequence
actgcatttatttttcttcc

SEQ ID NO: 814033 - DNA, 20 bp, Artificial
  CRISPR gRNA sequence
catttatttttcttcctatt

SEQ ID NO: 814034 - DNA, 20 bp, Artificial
  CRISPR gRNA sequence
atttttcttcctattctcta

SEQ ID NO: 814035 - DNA, 20 bp, Artificial
  CRISPR gRNA sequence
tttttcttcctattctctat

SEQ ID NO: 814036 - DNA, 20 bp, Artificial
  CRISPR gRNA sequence
ttcttcctattctctattta

SEQ ID NO: 814037 - DNA, 20 bp, Artificial
  CRISPR gRNA sequence
tcttcctattctctatttac

SEQ ID NO: 814038 - DNA, 20 bp, Artificial
  CRISPR gRNA sequence
cttcctattctctatttacc

SEQ ID NO: 814039 - DNA, 20 bp, Artificial
  CRISPR gRNA sequence
ttcctattctctatttacca

SEQ ID NO: 814040 - DNA, 20 bp, Artificial
  CRISPR gRNA sequence
cctattctctatttaccagt

SEQ ID NO: 814041 - DNA, 20 bp, Artificial
  CRISPR gRNA sequence
ctattctctatttaccagtg

SEQ ID NO: 814042 - DNA, 20 bp, Artificial
  CRISPR gRNA sequence
ttctctatttaccagtgcaa

SEQ ID NO: 814043 - DNA, 20 bp, Artificial
  CRISPR gRNA sequence
tctatttaccagtgcaaatg

SEQ ID NO: 814044 - DNA, 20 bp, Artificial
  CRISPR gRNA sequence
tatttaccagtgcaaatgat

SEQ ID NO: 814045 - DNA, 20 bp, Artificial
  CRISPR gRNA sequence
tttaccagtgcaaatgatac

SEQ ID NO: 814046 - DNA, 20 bp, Artificial
  CRISPR gRNA sequence
accagtgcaaatgatacttg

SEQ ID NO: 814047 - DNA, 20 bp, Artificial
  CRISPR gRNA sequence
ccagtgcaaatgatacttgt

SEQ ID NO: 814048 - DNA, 20 bp, Artificial
  CRISPR gRNA sequence
gtttttcatctaccacaggg

SEQ ID NO: 814049 - DNA, 20 bp, Artificial
  CRISPR gRNA sequence
tttttcatctaccacagggg

SEQ ID NO: 814050 - DNA, 20 bp, Artificial
  CRISPR gRNA sequence
ttcatctaccacaggggtat

SEQ ID NO: 814051 - DNA, 20 bp, Artificial
  CRISPR gRNA sequence
tcatctaccacaggggtatg

SEQ ID NO: 814052 - DNA, 20 bp, Artificial
  CRISPR gRNA sequence
catctaccacaggggtatgt

SEQ ID NO: 814053 - DNA, 20 bp, Artificial
  CRISPR gRNA sequence
atctaccacaggggtatgtg

SEQ ID NO: 814054 - DNA, 20 bp, Artificial
  CRISPR gRNA sequence
ccacaggggtatgtggcttt

SEQ ID NO: 814055 - DNA, 20 bp, Artificial
  CRISPR gRNA sequence
tattttttaaaagttgaatt

SEQ ID NO: 814056 - DNA, 20 bp, Artificial
  CRISPR gRNA sequence
attttttaaaagttgaattg

SEQ ID NO: 814057 - DNA, 20 bp, Artificial
  CRISPR gRNA sequence
ttttttaaaagttgaattga

SEQ ID NO: 814058 - DNA, 20 bp, Artificial
  CRISPR gRNA sequence
tttaaaagttgaattgatct

SEQ ID NO: 814059 - DNA, 20 bp, Artificial
  CRISPR gRNA sequence
ttaaaagttgaattgatcta

SEQ ID NO: 814060 - DNA, 20 bp, Artificial
  CRISPR gRNA sequence
taaaagttgaattgatctaa

SEQ ID NO: 814061 - DNA, 20 bp, Artificial
  CRISPR gRNA sequence
aaaagttgaattgatctaaa

SEQ ID NO: 814062 - DNA, 20 bp, Artificial
  CRISPR gRNA sequence
aaagttgaattgatctaaat

SEQ ID NO: 814063 - DNA, 20 bp, Artificial
  CRISPR gRNA sequence
aattgatctaaatagttcta

SEQ ID NO: 814064 - DNA, 20 bp, Artificial
  CRISPR gRNA sequence
atctaaatagttctataaaa

SEQ ID NO: 814065 - DNA, 20 bp, Artificial
  CRISPR gRNA sequence
aatagttctataaaaaaagc

SEQ ID NO: 814066 - DNA, 20 bp, Artificial
  CRISPR gRNA sequence
tataaaaaaagcataaggag

SEQ ID NO: 814067 - DNA, 20 bp, Artificial
  CRISPR gRNA sequence
taaaaaaagcataaggagtg

SEQ ID NO: 814068 - DNA, 20 bp, Artificial
  CRISPR gRNA sequence
gtaaaggtagtgttacatca

SEQ ID NO: 814069 - DNA, 20 bp, Artificial
  CRISPR gRNA sequence
catcaataaagtgtgaaaaa

SEQ ID NO: 814070 - DNA, 20 bp, Artificial
  CRISPR gRNA sequence
ggctgcttccatcattaatg

SEQ ID NO: 814071 - DNA, 20 bp, Artificial
  CRISPR gRNA sequence
cttccatcattaatgaatgg

SEQ ID NO: 814072 - DNA, 20 bp, Artificial
  CRISPR gRNA sequence
ccatcattaatgaatgggta

SEQ ID NO: 814073 - DNA, 20 bp, Artificial
  CRISPR gRNA sequence
catcattaatgaatgggtat

SEQ ID NO: 814074 - DNA, 20 bp, Artificial
  CRISPR gRNA sequence
atgaatgggtattcattatg

SEQ ID NO: 814075 - DNA, 20 bp, Artificial
  CRISPR gRNA sequence
attatgatggaggtatagga

SEQ ID NO: 814076 - DNA, 20 bp, Artificial
  CRISPR gRNA sequence
tgatggaggtataggaaaat

SEQ ID NO: 814077 - DNA, 20 bp, Artificial
  CRISPR gRNA sequence
gaagtagtttctgaataatc

SEQ ID NO: 814078 - DNA, 20 bp, Artificial
  CRISPR gRNA sequence
aagtagtttctgaataatca

SEQ ID NO: 814079 - DNA, 20 bp, Artificial
  CRISPR gRNA sequence
ctgaataatcacagaagatt

SEQ ID NO: 814080 - DNA, 20 bp, Artificial
  CRISPR gRNA sequence
tgaataatcacagaagatta

SEQ ID NO: 814081 - DNA, 20 bp, Artificial
  CRISPR gRNA sequence
aataatcacagaagattaga

SEQ ID NO: 814082 - DNA, 20 bp, Artificial
  CRISPR gRNA sequence
gatcaaattatgttcagtag

SEQ ID NO: 814083 - DNA, 20 bp, Artificial
  CRISPR gRNA sequence
tgttcagtagagcttgcttc

SEQ ID NO: 814084 - DNA, 20 bp, Artificial
  CRISPR gRNA sequence
agtagagcttgcttcattca

SEQ ID NO: 814085 - DNA, 20 bp, Artificial
  CRISPR gRNA sequence
gcttcattcatttattcatt

SEQ ID NO: 814086 - DNA, 20 bp, Artificial
  CRISPR gRNA sequence
cttcattcatttattcattc

SEQ ID NO: 814087 - DNA, 20 bp, Artificial
  CRISPR gRNA sequence
cattcatttattcattcatt

SEQ ID NO: 814088 - DNA, 20 bp, Artificial
  CRISPR gRNA sequence
attcatttattcattcattc

SEQ ID NO: 814089 - DNA, 20 bp, Artificial
  CRISPR gRNA sequence
atttattcattcattcaatc

SEQ ID NO: 814090 - DNA, 20 bp, Artificial
  CRISPR gRNA sequence
attcattcattcaatcaaat

SEQ ID NO: 814091 - DNA, 20 bp, Artificial
  CRISPR gRNA sequence
ttcattcattcaatcaaatc

SEQ ID NO: 814092 - DNA, 20 bp, Artificial
  CRISPR gRNA sequence
attcattcaatcaaatcatt

SEQ ID NO: 814093 - DNA, 20 bp, Artificial
  CRISPR gRNA sequence
attcaatcaaatcattcatt

SEQ ID NO: 814094 - DNA, 20 bp, Artificial
  CRISPR gRNA sequence
aatcaaatcattcattcaac

SEQ ID NO: 814095 - DNA, 20 bp, Artificial
  CRISPR gRNA sequence
attcaacaaatatttgggag

SEQ ID NO: 814096 - DNA, 20 bp, Artificial
  CRISPR gRNA sequence
aacaaatatttgggagctgc

SEQ ID NO: 814097 - DNA, 20 bp, Artificial
  CRISPR gRNA sequence
gggagctgcttctaagcatt

SEQ ID NO: 814098 - DNA, 20 bp, Artificial
  CRISPR gRNA sequence
ggagctgcttctaagcatta

SEQ ID NO: 814099 - DNA, 20 bp, Artificial
  CRISPR gRNA sequence
cttctaagcattagctattc

SEQ ID NO: 814100 - DNA, 20 bp, Artificial
  CRISPR gRNA sequence
ctaagcattagctattccag

SEQ ID NO: 814101 - DNA, 20 bp, Artificial
  CRISPR gRNA sequence
taagcattagctattccaga

SEQ ID NO: 814102 - DNA, 20 bp, Artificial
  CRISPR gRNA sequence
agcattagctattccagaag

SEQ ID NO: 814103 - DNA, 20 bp, Artificial
  CRISPR gRNA sequence
gctattccagaagttgtttc

SEQ ID NO: 814104 - DNA, 20 bp, Artificial
  CRISPR gRNA sequence
ttccagaagttgtttcagta

SEQ ID NO: 814105 - DNA, 20 bp, Artificial
  CRISPR gRNA sequence
cagaagttgtttcagtataa

SEQ ID NO: 814106 - DNA, 20 bp, Artificial
  CRISPR gRNA sequence
tttcagtataaaatgtgata

SEQ ID NO: 814107 - DNA, 20 bp, Artificial
  CRISPR gRNA sequence
cagtataaaatgtgatacgg

SEQ ID NO: 814108 - DNA, 20 bp, Artificial
  CRISPR gRNA sequence
agtataaaatgtgatacgga

SEQ ID NO: 814109 - DNA, 20 bp, Artificial
  CRISPR gRNA sequence
ggttcaaatgctgactcagg

SEQ ID NO: 814110 - DNA, 20 bp, Artificial
  CRISPR gRNA sequence
aaatgctgactcaggattag

SEQ ID NO: 814111 - DNA, 20 bp, Artificial
  CRISPR gRNA sequence
actcaggattaggagtcctt

SEQ ID NO: 814112 - DNA, 20 bp, Artificial
  CRISPR gRNA sequence
aggattaggagtcctttgac

SEQ ID NO: 814113 - DNA, 20 bp, Artificial
  CRISPR gRNA sequence
ggagtcctttgactgtgagt

SEQ ID NO: 814114 - DNA, 20 bp, Artificial
  CRISPR gRNA sequence
tgactgtgagtccgtccttt

SEQ ID NO: 814115 - DNA, 20 bp, Artificial
  CRISPR gRNA sequence
gactgtgagtccgtccttta

SEQ ID NO: 814116 - DNA, 20 bp, Artificial
  CRISPR gRNA sequence
actgtgagtccgtcctttaa

SEQ ID NO: 814117 - DNA, 20 bp, Artificial
  CRISPR gRNA sequence
tgagtccgtcctttaatctt

SEQ ID NO: 814118 - DNA, 20 bp, Artificial
  CRISPR gRNA sequence
taatctttatgagcttcagc

SEQ ID NO: 814119 - DNA, 20 bp, Artificial
  CRISPR gRNA sequence
aatctttatgagcttcagcc

SEQ ID NO: 814120 - DNA, 20 bp, Artificial
  CRISPR gRNA sequence
atctttatgagcttcagcct

SEQ ID NO: 814121 - DNA, 20 bp, Artificial
  CRISPR gRNA sequence
tatgagcttcagcctcttta

SEQ ID NO: 814122 - DNA, 20 bp, Artificial
  CRISPR gRNA sequence
atgagcttcagcctctttat

SEQ ID NO: 814123 - DNA, 20 bp, Artificial
  CRISPR gRNA sequence
tgagcttcagcctctttatc

SEQ ID NO: 814124 - DNA, 20 bp, Artificial
  CRISPR gRNA sequence
cagcctctttatctataaaa

SEQ ID NO: 814125 - DNA, 20 bp, Artificial
  CRISPR gRNA sequence
agcctctttatctataaaat

SEQ ID NO: 814126 - DNA, 20 bp, Artificial
  CRISPR gRNA sequence
tttatctataaaatgaggtt

SEQ ID NO: 814127 - DNA, 20 bp, Artificial
  CRISPR gRNA sequence
tatctataaaatgaggttga

SEQ ID NO: 814128 - DNA, 20 bp, Artificial
  CRISPR gRNA sequence
atctataaaatgaggttgaa

SEQ ID NO: 814129 - DNA, 20 bp, Artificial
  CRISPR gRNA sequence
tctataaaatgaggttgaac

SEQ ID NO: 814130 - DNA, 20 bp, Artificial
  CRISPR gRNA sequence
taaaatgaggttgaactcta

SEQ ID NO: 814131 - DNA, 20 bp, Artificial
  CRISPR gRNA sequence
aactctacctctcagtattg

SEQ ID NO: 814132 - DNA, 20 bp, Artificial
  CRISPR gRNA sequence
tacctctcagtattgtggtg

SEQ ID NO: 814133 - DNA, 20 bp, Artificial
  CRISPR gRNA sequence
cctctcagtattgtggtgga

SEQ ID NO: 814134 - DNA, 20 bp, Artificial
  CRISPR gRNA sequence
tcagtattgtggtggaggct

SEQ ID NO: 814135 - DNA, 20 bp, Artificial
  CRISPR gRNA sequence
agtattgtggtggaggctgg

SEQ ID NO: 814136 - DNA, 20 bp, Artificial
  CRISPR gRNA sequence
tggtggaggctggacgaggt

SEQ ID NO: 814137 - DNA, 20 bp, Artificial
  CRISPR gRNA sequence
gacgaggtgttacatgtgaa

SEQ ID NO: 814138 - DNA, 20 bp, Artificial
  CRISPR gRNA sequence
catgtgaagtgcctagatct

SEQ ID NO: 814139 - DNA, 20 bp, Artificial
  CRISPR gRNA sequence
gatctggcaggcagtaggca

SEQ ID NO: 814140 - DNA, 20 bp, Artificial
  CRISPR gRNA sequence
gcaggcagtaggcactcagc

SEQ ID NO: 814141 - DNA, 20 bp, Artificial
  CRISPR gRNA sequence
agcaaatgttcgttcctttc

SEQ ID NO: 814142 - DNA, 20 bp, Artificial
  CRISPR gRNA sequence
gttcctttctttcgtaccat

SEQ ID NO: 814143 - DNA, 20 bp, Artificial
  CRISPR gRNA sequence
ctttctttcgtaccatgttt

SEQ ID NO: 814144 - DNA, 20 bp, Artificial
  CRISPR gRNA sequence
tctttcgtaccatgttttaa

SEQ ID NO: 814145 - DNA, 20 bp, Artificial
  CRISPR gRNA sequence
ctttcgtaccatgttttaat

SEQ ID NO: 814146 - DNA, 20 bp, Artificial
  CRISPR gRNA sequence
tttcgtaccatgttttaatt

SEQ ID NO: 814147 - DNA, 20 bp, Artificial
  CRISPR gRNA sequence
tcgtaccatgttttaattct

SEQ ID NO: 814148 - DNA, 20 bp, Artificial
  CRISPR gRNA sequence
cgtaccatgttttaattctt

SEQ ID NO: 814149 - DNA, 20 bp, Artificial
  CRISPR gRNA sequence
gtaccatgttttaattcttg

SEQ ID NO: 814150 - DNA, 20 bp, Artificial
  CRISPR gRNA sequence
taattcttgggaaagtggta

SEQ ID NO: 814151 - DNA, 20 bp, Artificial
  CRISPR gRNA sequence
aattcttgggaaagtggtaa

SEQ ID NO: 814152 - DNA, 20 bp, Artificial
  CRISPR gRNA sequence
attcttgggaaagtggtaat

SEQ ID NO: 814153 - DNA, 20 bp, Artificial
  CRISPR gRNA sequence
ttgggaaagtggtaattcat

SEQ ID NO: 814154 - DNA, 20 bp, Artificial
  CRISPR gRNA sequence
gggaaagtggtaattcatat

SEQ ID NO: 814155 - DNA, 20 bp, Artificial
  CRISPR gRNA sequence
ggaaagtggtaattcatatg

SEQ ID NO: 814156 - DNA, 20 bp, Artificial
  CRISPR gRNA sequence
atatgtggaatgcatggcca

SEQ ID NO: 814157 - DNA, 20 bp, Artificial
  CRISPR gRNA sequence
tatcctccaggatattttac

SEQ ID NO: 814158 - DNA, 20 bp, Artificial
  CRISPR gRNA sequence
atcctccaggatattttact

SEQ ID NO: 814159 - DNA, 20 bp, Artificial
  CRISPR gRNA sequence
tcctccaggatattttacta

SEQ ID NO: 814160 - DNA, 20 bp, Artificial
  CRISPR gRNA sequence
caggatattttactaaccag

SEQ ID NO: 814161 - DNA, 20 bp, Artificial
  CRISPR gRNA sequence
tactaaccaggacagtccat

SEQ ID NO: 814162 - DNA, 20 bp, Artificial
  CRISPR gRNA sequence
actaaccaggacagtccatt

SEQ ID NO: 814163 - DNA, 20 bp, Artificial
  CRISPR gRNA sequence
ctaaccaggacagtccattc

SEQ ID NO: 814164 - DNA, 20 bp, Artificial
  CRISPR gRNA sequence
accaggacagtccattctct

SEQ ID NO: 814165 - DNA, 20 bp, Artificial
  CRISPR gRNA sequence
tctgatcagatttcacagta

SEQ ID NO: 814166 - DNA, 20 bp, Artificial
  CRISPR gRNA sequence
tgatcagatttcacagtata

SEQ ID NO: 814167 - DNA, 20 bp, Artificial
  CRISPR gRNA sequence
atcagatttcacagtataag

SEQ ID NO: 814168 - DNA, 20 bp, Artificial
  CRISPR gRNA sequence
cacagtataagtaacttttg

SEQ ID NO: 814169 - DNA, 20 bp, Artificial
  CRISPR gRNA sequence
acagtataagtaacttttgg

SEQ ID NO: 814170 - DNA, 20 bp, Artificial
  CRISPR gRNA sequence
ttgggttttctgctgcttga

SEQ ID NO: 814171 - DNA, 20 bp, Artificial
  CRISPR gRNA sequence
tgggttttctgctgcttgaa

SEQ ID NO: 814172 - DNA, 20 bp, Artificial
  CRISPR gRNA sequence
gggttttctgctgcttgaat

SEQ ID NO: 814173 - DNA, 20 bp, Artificial
  CRISPR gRNA sequence
ggttttctgctgcttgaatg

SEQ ID NO: 814174 - DNA, 20 bp, Artificial
  CRISPR gRNA sequence
tctgctgcttgaatgattcc

SEQ ID NO: 814175 - DNA, 20 bp, Artificial
  CRISPR gRNA sequence
ctgctgcttgaatgattccc

SEQ ID NO: 814176 - DNA, 20 bp, Artificial
  CRISPR gRNA sequence
tgctgcttgaatgattccca

SEQ ID NO: 814177 - DNA, 20 bp, Artificial
  CRISPR gRNA sequence
ctgcttgaatgattcccact

SEQ ID NO: 814178 - DNA, 20 bp, Artificial
  CRISPR gRNA sequence
cttgaatgattcccactgca

SEQ ID NO: 814179 - DNA, 20 bp, Artificial
  CRISPR gRNA sequence
gaatgattcccactgcagat

SEQ ID NO: 814180 - DNA, 20 bp, Artificial
  CRISPR gRNA sequence
aatgattcccactgcagatg

SEQ ID NO: 814181 - DNA, 20 bp, Artificial
  CRISPR gRNA sequence
ccactgcagatgtcctctga

SEQ ID NO: 814182 - DNA, 20 bp, Artificial
  CRISPR gRNA sequence
cagatgtcctctgattcaag

SEQ ID NO: 814183 - DNA, 20 bp, Artificial
  CRISPR gRNA sequence
tgattcaagtttttcttccc

SEQ ID NO: 814184 - DNA, 20 bp, Artificial
  CRISPR gRNA sequence
attcaagtttttcttcccac

SEQ ID NO: 814185 - DNA, 20 bp, Artificial
  CRISPR gRNA sequence
aagtttttcttcccactatc

SEQ ID NO: 814186 - DNA, 20 bp, Artificial
  CRISPR gRNA sequence
ttcttcccactatcctgcaa

SEQ ID NO: 814187 - DNA, 20 bp, Artificial
  CRISPR gRNA sequence
tcttcccactatcctgcaaa

SEQ ID NO: 814188 - DNA, 20 bp, Artificial
  CRISPR gRNA sequence
cttcccactatcctgcaaat

SEQ ID NO: 814189 - DNA, 20 bp, Artificial
  CRISPR gRNA sequence
ttcccactatcctgcaaatc

SEQ ID NO: 814190 - DNA, 20 bp, Artificial
  CRISPR gRNA sequence
cccactatcctgcaaatctt

SEQ ID NO: 814191 - DNA, 20 bp, Artificial
  CRISPR gRNA sequence
ccactatcctgcaaatcttt

SEQ ID NO: 814192 - DNA, 20 bp, Artificial
  CRISPR gRNA sequence
tcctgcaaatctttgaaggc

SEQ ID NO: 814193 - DNA, 20 bp, Artificial
  CRISPR gRNA sequence
caaatctttgaaggcaaaga

SEQ ID NO: 814194 - DNA, 20 bp, Artificial
  CRISPR gRNA sequence
tgaaggcaaagaccaggctg

SEQ ID NO: 814195 - DNA, 20 bp, Artificial
  CRISPR gRNA sequence
gaaggcaaagaccaggctga

SEQ ID NO: 814196 - DNA, 20 bp, Artificial
  CRISPR gRNA sequence
aaggcaaagaccaggctgag

SEQ ID NO: 814197 - DNA, 20 bp, Artificial
  CRISPR gRNA sequence
agtttgctttgatatatcca

SEQ ID NO: 814198 - DNA, 20 bp, Artificial
  CRISPR gRNA sequence
gctttgatatatccagtacc

SEQ ID NO: 814199 - DNA, 20 bp, Artificial
  CRISPR gRNA sequence
ctttgatatatccagtacct

SEQ ID NO: 814200 - DNA, 20 bp, Artificial
  CRISPR gRNA sequence
tgatatatccagtacctagc

SEQ ID NO: 814201 - DNA, 20 bp, Artificial
  CRISPR gRNA sequence
gatatatccagtacctagca

SEQ ID NO: 814202 - DNA, 20 bp, Artificial
  CRISPR gRNA sequence
atatatccagtacctagcac

SEQ ID NO: 814203 - DNA, 20 bp, Artificial
  CRISPR gRNA sequence
gcacatagcaagttctagtt

SEQ ID NO: 814204 - DNA, 20 bp, Artificial
  CRISPR gRNA sequence
tagttaagagcttggcaaat

SEQ ID NO: 814205 - DNA, 20 bp, Artificial
  CRISPR gRNA sequence
gttaagagcttggcaaataa

SEQ ID NO: 814206 - DNA, 20 bp, Artificial
  CRISPR gRNA sequence
agagcttggcaaataaatga

SEQ ID NO: 814207 - DNA, 20 bp, Artificial
  CRISPR gRNA sequence
ggcaaataaatgacagaaag

SEQ ID NO: 814208 - DNA, 20 bp, Artificial
  CRISPR gRNA sequence
gcaaataaatgacagaaaga

SEQ ID NO: 814209 - DNA, 20 bp, Artificial
  CRISPR gRNA sequence
gttatatattcacctctgct

SEQ ID NO: 814210 - DNA, 20 bp, Artificial
  CRISPR gRNA sequence
tatattcacctctgctttcc

SEQ ID NO: 814211 - DNA, 20 bp, Artificial
  CRISPR gRNA sequence
acctctgctttcctttcatc

SEQ ID NO: 814212 - DNA, 20 bp, Artificial
  CRISPR gRNA sequence
tgctttcctttcatcaaact

SEQ ID NO: 814213 - DNA, 20 bp, Artificial
  CRISPR gRNA sequence
ctttcctttcatcaaactgc

SEQ ID NO: 814214 - DNA, 20 bp, Artificial
  CRISPR gRNA sequence
tcctttcatcaaactgcaac

SEQ ID NO: 814215 - DNA, 20 bp, Artificial
  CRISPR gRNA sequence
cctttcatcaaactgcaact

SEQ ID NO: 814216 - DNA, 20 bp, Artificial
  CRISPR gRNA sequence
ctttcatcaaactgcaactt

SEQ ID NO: 814217 - DNA, 20 bp, Artificial
  CRISPR gRNA sequence
tcatcaaactgcaacttgcc

SEQ ID NO: 814218 - DNA, 20 bp, Artificial
  CRISPR gRNA sequence
catcaaactgcaacttgcct

SEQ ID NO: 814219 - DNA, 20 bp, Artificial
  CRISPR gRNA sequence
atcaaactgcaacttgcctg

SEQ ID NO: 814220 - DNA, 20 bp, Artificial
  CRISPR gRNA sequence
caacttgcctgtgatcacac

SEQ ID NO: 814221 - DNA, 20 bp, Artificial
  CRISPR gRNA sequence
gcctgtgatcacacaaattg

SEQ ID NO: 814222 - DNA, 20 bp, Artificial
  CRISPR gRNA sequence
cctgtgatcacacaaattgg

SEQ ID NO: 814223 - DNA, 20 bp, Artificial
  CRISPR gRNA sequence
tgatcacacaaattggcatt

SEQ ID NO: 814224 - DNA, 20 bp, Artificial
  CRISPR gRNA sequence
gcattcttaattgccacaca

SEQ ID NO: 814225 - DNA, 20 bp, Artificial
  CRISPR gRNA sequence
ttaattgccacacagcacac

SEQ ID NO: 814226 - DNA, 20 bp, Artificial
  CRISPR gRNA sequence
aattgccacacagcacactt

SEQ ID NO: 814227 - DNA, 20 bp, Artificial
  CRISPR gRNA sequence
attgccacacagcacacttg

SEQ ID NO: 814228 - DNA, 20 bp, Artificial
  CRISPR gRNA sequence
ccacacagcacacttgatag

SEQ ID NO: 814229 - DNA, 20 bp, Artificial
  CRISPR gRNA sequence
gatagtgatatgcacaaact

SEQ ID NO: 814230 - DNA, 20 bp, Artificial
  CRISPR gRNA sequence
atagtgatatgcacaaactt

SEQ ID NO: 814231 - DNA, 20 bp, Artificial
  CRISPR gRNA sequence
gagatttatttcaaatgacc

SEQ ID NO: 814232 - DNA, 20 bp, Artificial
  CRISPR gRNA sequence
agatttatttcaaatgaccg

SEQ ID NO: 814233 - DNA, 20 bp, Artificial
  CRISPR gRNA sequence
atttcaaatgaccgacattt

SEQ ID NO: 814234 - DNA, 20 bp, Artificial
  CRISPR gRNA sequence
tttcaaatgaccgacatttt

SEQ ID NO: 814235 - DNA, 20 bp, Artificial
  CRISPR gRNA sequence
caaatgaccgacatttttgg

SEQ ID NO: 814236 - DNA, 20 bp, Artificial
  CRISPR gRNA sequence
aaatgaccgacatttttggc

SEQ ID NO: 814237 - DNA, 20 bp, Artificial
  CRISPR gRNA sequence
ttggcttgcctctatccctg

SEQ ID NO: 814238 - DNA, 20 bp, Artificial
  CRISPR gRNA sequence
tggcttgcctctatccctgt

SEQ ID NO: 814239 - DNA, 20 bp, Artificial
  CRISPR gRNA sequence
ggcttgcctctatccctgtt

SEQ ID NO: 814240 - DNA, 20 bp, Artificial
  CRISPR gRNA sequence
gcttgcctctatccctgttt

SEQ ID NO: 814241 - DNA, 20 bp, Artificial
  CRISPR gRNA sequence
gcctctatccctgttttaac

SEQ ID NO: 814242 - DNA, 20 bp, Artificial
  CRISPR gRNA sequence
cctctatccctgttttaacc

SEQ ID NO: 814243 - DNA, 20 bp, Artificial
  CRISPR gRNA sequence
tatccctgttttaaccatgg

SEQ ID NO: 814244 - DNA, 20 bp, Artificial
  CRISPR gRNA sequence
tccctgttttaaccatggct

SEQ ID NO: 814245 - DNA, 20 bp, Artificial
  CRISPR gRNA sequence
ttttaaccatggctagaaca

SEQ ID NO: 814246 - DNA, 20 bp, Artificial
  CRISPR gRNA sequence
taaccatggctagaacatta

SEQ ID NO: 814247 - DNA, 20 bp, Artificial
  CRISPR gRNA sequence
aaccatggctagaacattaa

SEQ ID NO: 814248 - DNA, 20 bp, Artificial
  CRISPR gRNA sequence
accatggctagaacattaat

SEQ ID NO: 814249 - DNA, 20 bp, Artificial
  CRISPR gRNA sequence
gaacattaatgtgcctttct

SEQ ID NO: 814250 - DNA, 20 bp, Artificial
  CRISPR gRNA sequence
atgtgcctttctacagagag

SEQ ID NO: 814251 - DNA, 20 bp, Artificial
  CRISPR gRNA sequence
tctacagagaggagttcacg

SEQ ID NO: 814252 - DNA, 20 bp, Artificial
  CRISPR gRNA sequence
ctacagagaggagttcacgt

SEQ ID NO: 814253 - DNA, 20 bp, Artificial
  CRISPR gRNA sequence
tacagagaggagttcacgtg

SEQ ID NO: 814254 - DNA, 20 bp, Artificial
  CRISPR gRNA sequence
cagagaggagttcacgtgtg

SEQ ID NO: 814255 - DNA, 20 bp, Artificial
  CRISPR gRNA sequence
acgtgtgcccagcattcttt

SEQ ID NO: 814256 - DNA, 20 bp, Artificial
  CRISPR gRNA sequence
ttttgtgcaggaggggcaca

SEQ ID NO: 814257 - DNA, 20 bp, Artificial
  CRISPR gRNA sequence
ttgtgcaggaggggcacagg

SEQ ID NO: 814258 - DNA, 20 bp, Artificial
  CRISPR gRNA sequence
tgtgcaggaggggcacaggg

SEQ ID NO: 814259 - DNA, 20 bp, Artificial
  CRISPR gRNA sequence
gtgcaggaggggcacagggg

SEQ ID NO: 814260 - DNA, 20 bp, Artificial
  CRISPR gRNA sequence
tgcaggaggggcacaggggc

SEQ ID NO: 814261 - DNA, 20 bp, Artificial
  CRISPR gRNA sequence
taaggtgagtgtacatgtgt

SEQ ID NO: 814262 - DNA, 20 bp, Artificial
  CRISPR gRNA sequence
atcatatctgcacttgctgt

SEQ ID NO: 814263 - DNA, 20 bp, Artificial
  CRISPR gRNA sequence
cacttgctgtgccaggttgc

SEQ ID NO: 814264 - DNA, 20 bp, Artificial
  CRISPR gRNA sequence
gctgtgccaggttgcaaaga

SEQ ID NO: 814265 - DNA, 20 bp, Artificial
  CRISPR gRNA sequence
ctgtgccaggttgcaaagac

SEQ ID NO: 814266 - DNA, 20 bp, Artificial
  CRISPR gRNA sequence
tgccaggttgcaaagaccct

SEQ ID NO: 814267 - DNA, 20 bp, Artificial
  CRISPR gRNA sequence
caaagaccctggaataaggc

SEQ ID NO: 814268 - DNA, 20 bp, Artificial
  CRISPR gRNA sequence
gaataaggcatgtaaaaaga

SEQ ID NO: 814269 - DNA, 20 bp, Artificial
  CRISPR gRNA sequence
cctgtatgattcttttattt

SEQ ID NO: 814270 - DNA, 20 bp, Artificial
  CRISPR gRNA sequence
ctgtatgattcttttatttt

SEQ ID NO: 814271 - DNA, 20 bp, Artificial
  CRISPR gRNA sequence
tatgattcttttattttaat

SEQ ID NO: 814272 - DNA, 20 bp, Artificial
  CRISPR gRNA sequence
ttttattttaatccactgca

SEQ ID NO: 814273 - DNA, 20 bp, Artificial
  CRISPR gRNA sequence
ttattttaatccactgcaca

SEQ ID NO: 814274 - DNA, 20 bp, Artificial
  CRISPR gRNA sequence
tattttaatccactgcacac

SEQ ID NO: 814275 - DNA, 20 bp, Artificial
  CRISPR gRNA sequence
attttaatccactgcacact

SEQ ID NO: 814276 - DNA, 20 bp, Artificial
  CRISPR gRNA sequence
ttttaatccactgcacactt

SEQ ID NO: 814277 - DNA, 20 bp, Artificial
  CRISPR gRNA sequence
taatccactgcacacttgga

SEQ ID NO: 814278 - DNA, 20 bp, Artificial
  CRISPR gRNA sequence
aatccactgcacacttggaa

SEQ ID NO: 814279 - DNA, 20 bp, Artificial
  CRISPR gRNA sequence
atccactgcacacttggaat

SEQ ID NO: 814280 - DNA, 20 bp, Artificial
  CRISPR gRNA sequence
cacacttggaatagctctca

SEQ ID NO: 814281 - DNA, 20 bp, Artificial
  CRISPR gRNA sequence
ggaatagctctcacctcaga

SEQ ID NO: 814282 - DNA, 20 bp, Artificial
  CRISPR gRNA sequence
gaatagctctcacctcagaa

SEQ ID NO: 814283 - DNA, 20 bp, Artificial
  CRISPR gRNA sequence
tcacctcagaatctccataa

SEQ ID NO: 814284 - DNA, 20 bp, Artificial
  CRISPR gRNA sequence
acctcagaatctccataatg

SEQ ID NO: 814285 - DNA, 20 bp, Artificial
  CRISPR gRNA sequence
agaatctccataatgggacc

SEQ ID NO: 814286 - DNA, 20 bp, Artificial
  CRISPR gRNA sequence
cataatgggaccctcttaag

SEQ ID NO: 814287 - DNA, 20 bp, Artificial
  CRISPR gRNA sequence
ttaagggcagatccctttat

SEQ ID NO: 814288 - DNA, 20 bp, Artificial
  CRISPR gRNA sequence
aagggcagatccctttatga

SEQ ID NO: 814289 - DNA, 20 bp, Artificial
  CRISPR gRNA sequence
agggcagatccctttatgat

SEQ ID NO: 814290 - DNA, 20 bp, Artificial
  CRISPR gRNA sequence
tatgatggaagccgtcctta

SEQ ID NO: 814291 - DNA, 20 bp, Artificial
  CRISPR gRNA sequence
atgatggaagccgtccttaa

SEQ ID NO: 814292 - DNA, 20 bp, Artificial
  CRISPR gRNA sequence
tgatggaagccgtccttaaa

SEQ ID NO: 814293 - DNA, 20 bp, Artificial
  CRISPR gRNA sequence
aaatacttgagttattaagt

SEQ ID NO: 814294 - DNA, 20 bp, Artificial
  CRISPR gRNA sequence
aatacttgagttattaagtc

SEQ ID NO: 814295 - DNA, 20 bp, Artificial
  CRISPR gRNA sequence
gagttattaagtcccttata

SEQ ID NO: 814296 - DNA, 20 bp, Artificial
  CRISPR gRNA sequence
agttattaagtcccttataa

SEQ ID NO: 814297 - DNA, 20 bp, Artificial
  CRISPR gRNA sequence
ttaagtcccttataacttaa

SEQ ID NO: 814298 - DNA, 20 bp, Artificial
  CRISPR gRNA sequence
agtcccttataacttaatgc

SEQ ID NO: 814299 - DNA, 20 bp, Artificial
  CRISPR gRNA sequence
ataacttaatgcagagccac

SEQ ID NO: 814300 - DNA, 20 bp, Artificial
  CRISPR gRNA sequence
taacttaatgcagagccacc

SEQ ID NO: 814301 - DNA, 20 bp, Artificial
  CRISPR gRNA sequence
aatgcagagccacctgatac

SEQ ID NO: 814302 - DNA, 20 bp, Artificial
  CRISPR gRNA sequence
atgcagagccacctgatacc

SEQ ID NO: 814303 - DNA, 20 bp, Artificial
  CRISPR gRNA sequence
ataccaaatccaatctgtcc

SEQ ID NO: 814304 - DNA, 20 bp, Artificial
  CRISPR gRNA sequence
tccttgaagaataatattca

SEQ ID NO: 814305 - DNA, 20 bp, Artificial
  CRISPR gRNA sequence
gaagaataatattcaactat

SEQ ID NO: 814306 - DNA, 20 bp, Artificial
  CRISPR gRNA sequence
aagaataatattcaactatt

SEQ ID NO: 814307 - DNA, 20 bp, Artificial
  CRISPR gRNA sequence
aactattcatcaaatatgta

SEQ ID NO: 814308 - DNA, 20 bp, Artificial
  CRISPR gRNA sequence
ttcatcaaatatgtagtaat

SEQ ID NO: 814309 - DNA, 20 bp, Artificial
  CRISPR gRNA sequence
atcaaatatgtagtaatcat

SEQ ID NO: 814310 - DNA, 20 bp, Artificial
  CRISPR gRNA sequence
aagaattacctactactttt

SEQ ID NO: 814311 - DNA, 20 bp, Artificial
  CRISPR gRNA sequence
cctactacttttactcttct

SEQ ID NO: 814312 - DNA, 20 bp, Artificial
  CRISPR gRNA sequence
ctacttttactcttctataa

SEQ ID NO: 814313 - DNA, 20 bp, Artificial
  CRISPR gRNA sequence
cttttactcttctataatac

SEQ ID NO: 814314 - DNA, 20 bp, Artificial
  CRISPR gRNA sequence
ttactcttctataatacttc

SEQ ID NO: 814315 - DNA, 20 bp, Artificial
  CRISPR gRNA sequence
tactcttctataatacttct

SEQ ID NO: 814316 - DNA, 20 bp, Artificial
  CRISPR gRNA sequence
actcttctataatacttctc

SEQ ID NO: 814317 - DNA, 20 bp, Artificial
  CRISPR gRNA sequence
ctcttctataatacttctct

SEQ ID NO: 814318 - DNA, 20 bp, Artificial
  CRISPR gRNA sequence
ttctataatacttctcttgt

SEQ ID NO: 814319 - DNA, 20 bp, Artificial
  CRISPR gRNA sequence
ctataatacttctcttgttt

SEQ ID NO: 814320 - DNA, 20 bp, Artificial
  CRISPR gRNA sequence
tataatacttctcttgttta

SEQ ID NO: 814321 - DNA, 20 bp, Artificial
  CRISPR gRNA sequence
taatacttctcttgtttaat

SEQ ID NO: 814322 - DNA, 20 bp, Artificial
  CRISPR gRNA sequence
ctcttgtttaattacatttg

SEQ ID NO: 814323 - DNA, 20 bp, Artificial
  CRISPR gRNA sequence
tcttgtttaattacatttga

SEQ ID NO: 814324 - DNA, 20 bp, Artificial
  CRISPR gRNA sequence
ttgtttaattacatttgata

SEQ ID NO: 814325 - DNA, 20 bp, Artificial
  CRISPR gRNA sequence
gtttaattacatttgataaa

SEQ ID NO: 814326 - DNA, 20 bp, Artificial
  CRISPR gRNA sequence
tttaattacatttgataaac

SEQ ID NO: 814327 - DNA, 20 bp, Artificial
  CRISPR gRNA sequence
aattacatttgataaacagg

SEQ ID NO: 814328 - DNA, 20 bp, Artificial
  CRISPR gRNA sequence
attacatttgataaacagga

SEQ ID NO: 814329 - DNA, 20 bp, Artificial
  CRISPR gRNA sequence
catttgataaacaggaaaca

SEQ ID NO: 814330 - DNA, 20 bp, Artificial
  CRISPR gRNA sequence
gataaacaggaaacagggaa

SEQ ID NO: 814331 - DNA, 20 bp, Artificial
  CRISPR gRNA sequence
ataaacaggaaacagggaag

SEQ ID NO: 814332 - DNA, 20 bp, Artificial
  CRISPR gRNA sequence
acaaggaaggttagttgctg

SEQ ID NO: 814333 - DNA, 20 bp, Artificial
  CRISPR gRNA sequence
caaggaaggttagttgctga

SEQ ID NO: 814334 - DNA, 20 bp, Artificial
  CRISPR gRNA sequence
gttgctgagtctgcataaca

SEQ ID NO: 814335 - DNA, 20 bp, Artificial
  CRISPR gRNA sequence
ctgagtctgcataacaacaa

SEQ ID NO: 814336 - DNA, 20 bp, Artificial
  CRISPR gRNA sequence
agtctgcataacaacaagaa

SEQ ID NO: 814337 - DNA, 20 bp, Artificial
  CRISPR gRNA sequence
cataacaacaagaattaaat

SEQ ID NO: 814338 - DNA, 20 bp, Artificial
  CRISPR gRNA sequence
aatagatgactttgggtaga

SEQ ID NO: 814339 - DNA, 20 bp, Artificial
  CRISPR gRNA sequence
tgggtagagactgttgaatc

SEQ ID NO: 814340 - DNA, 20 bp, Artificial
  CRISPR gRNA sequence
gggtagagactgttgaatct

SEQ ID NO: 814341 - DNA, 20 bp, Artificial
  CRISPR gRNA sequence
ggtagagactgttgaatcta

SEQ ID NO: 814342 - DNA, 20 bp, Artificial
  CRISPR gRNA sequence
ttgaatctatttagcaaatt

SEQ ID NO: 814343 - DNA, 20 bp, Artificial
  CRISPR gRNA sequence
aatctatttagcaaatttat

SEQ ID NO: 814344 - DNA, 20 bp, Artificial
  CRISPR gRNA sequence
tttagcaaatttatttactg

SEQ ID NO: 814345 - DNA, 20 bp, Artificial
  CRISPR gRNA sequence
agcaaatttatttactgcac

SEQ ID NO: 814346 - DNA, 20 bp, Artificial
  CRISPR gRNA sequence
gcaaatttatttactgcact

SEQ ID NO: 814347 - DNA, 20 bp, Artificial
  CRISPR gRNA sequence
atttactgcactatgctttc

SEQ ID NO: 814348 - DNA, 20 bp, Artificial
  CRISPR gRNA sequence
tttactgcactatgctttct

SEQ ID NO: 814349 - DNA, 20 bp, Artificial
  CRISPR gRNA sequence
actgcactatgctttcttgt

SEQ ID NO: 814350 - DNA, 20 bp, Artificial
  CRISPR gRNA sequence
ctgcactatgctttcttgtc

SEQ ID NO: 814351 - DNA, 20 bp, Artificial
  CRISPR gRNA sequence
cactatgctttcttgtcata

SEQ ID NO: 814352 - DNA, 20 bp, Artificial
  CRISPR gRNA sequence
tgctttcttgtcataagaaa

SEQ ID NO: 814353 - DNA, 20 bp, Artificial
  CRISPR gRNA sequence
tcttgtcataagaaagggaa

SEQ ID NO: 814354 - DNA, 20 bp, Artificial
  CRISPR gRNA sequence
cttgtcataagaaagggaac

SEQ ID NO: 814355 - DNA, 20 bp, Artificial
  CRISPR gRNA sequence
ttgtcataagaaagggaacg

SEQ ID NO: 814356 - DNA, 20 bp, Artificial
  CRISPR gRNA sequence
gtcataagaaagggaacgcc

SEQ ID NO: 814357 - DNA, 20 bp, Artificial
  CRISPR gRNA sequence
tcataagaaagggaacgcct

SEQ ID NO: 814358 - DNA, 20 bp, Artificial
  CRISPR gRNA sequence
taacttcctctggaactccc

SEQ ID NO: 814359 - DNA, 20 bp, Artificial
  CRISPR gRNA sequence
cctctggaactccccttagc

SEQ ID NO: 814360 - DNA, 20 bp, Artificial
  CRISPR gRNA sequence
ctctggaactccccttagct

SEQ ID NO: 814361 - DNA, 20 bp, Artificial
  CRISPR gRNA sequence
tggaactccccttagcttac

SEQ ID NO: 814362 - DNA, 20 bp, Artificial
  CRISPR gRNA sequence
gaactccccttagcttacag

SEQ ID NO: 814363 - DNA, 20 bp, Artificial
  CRISPR gRNA sequence
cccttagcttacagcagaac

SEQ ID NO: 814364 - DNA, 20 bp, Artificial
  CRISPR gRNA sequence
agcttacagcagaactcccc

SEQ ID NO: 814365 - DNA, 20 bp, Artificial
  CRISPR gRNA sequence
gcttacagcagaactcccct

SEQ ID NO: 814366 - DNA, 20 bp, Artificial
  CRISPR gRNA sequence
acagcagaactcccctcttt

SEQ ID NO: 814367 - DNA, 20 bp, Artificial
  CRISPR gRNA sequence
cagcagaactcccctcttta

SEQ ID NO: 814368 - DNA, 20 bp, Artificial
  CRISPR gRNA sequence
ccctctttactgcctgggcc

SEQ ID NO: 814369 - DNA, 20 bp, Artificial
  CRISPR gRNA sequence
tttactgcctgggcctttga

SEQ ID NO: 814370 - DNA, 20 bp, Artificial
  CRISPR gRNA sequence
tactgcctgggcctttgata

SEQ ID NO: 814371 - DNA, 20 bp, Artificial
  CRISPR gRNA sequence
actgcctgggcctttgataa

SEQ ID NO: 814372 - DNA, 20 bp, Artificial
  CRISPR gRNA sequence
ctgcctgggcctttgataaa

SEQ ID NO: 814373 - DNA, 20 bp, Artificial
  CRISPR gRNA sequence
cctgggcctttgataaaagt

SEQ ID NO: 814374 - DNA, 20 bp, Artificial
  CRISPR gRNA sequence
ggcctttgataaaagtccat

SEQ ID NO: 814375 - DNA, 20 bp, Artificial
  CRISPR gRNA sequence
tgataaaagtccattttctt

SEQ ID NO: 814376 - DNA, 20 bp, Artificial
  CRISPR gRNA sequence
gataaaagtccattttcttc

SEQ ID NO: 814377 - DNA, 20 bp, Artificial
  CRISPR gRNA sequence
ataaaagtccattttcttcc

SEQ ID NO: 814378 - DNA, 20 bp, Artificial
  CRISPR gRNA sequence
tcttcctatttttcctgtct

SEQ ID NO: 814379 - DNA, 20 bp, Artificial
  CRISPR gRNA sequence
cttcctatttttcctgtctg

SEQ ID NO: 814380 - DNA, 20 bp, Artificial
  CRISPR gRNA sequence
ttcctatttttcctgtctgc

SEQ ID NO: 814381 - DNA, 20 bp, Artificial
  CRISPR gRNA sequence
cctatttttcctgtctgcct

SEQ ID NO: 814382 - DNA, 20 bp, Artificial
  CRISPR gRNA sequence
ctatttttcctgtctgcctt

SEQ ID NO: 814383 - DNA, 20 bp, Artificial
  CRISPR gRNA sequence
tttttcctgtctgccttgta

SEQ ID NO: 814384 - DNA, 20 bp, Artificial
  CRISPR gRNA sequence
ttcctgtctgccttgtaaga

SEQ ID NO: 814385 - DNA, 20 bp, Artificial
  CRISPR gRNA sequence
tcctgtctgccttgtaagaa

SEQ ID NO: 814386 - DNA, 20 bp, Artificial
  CRISPR gRNA sequence
cctgtctgccttgtaagaat

SEQ ID NO: 814387 - DNA, 20 bp, Artificial
  CRISPR gRNA sequence
ctgtctgccttgtaagaatg

SEQ ID NO: 814388 - DNA, 20 bp, Artificial
  CRISPR gRNA sequence
tctgccttgtaagaatgcgt

SEQ ID NO: 814389 - DNA, 20 bp, Artificial
  CRISPR gRNA sequence
ccttgtaagaatgcgtgcca

SEQ ID NO: 814390 - DNA, 20 bp, Artificial
  CRISPR gRNA sequence
gtaagaatgcgtgccaggag

SEQ ID NO: 814391 - DNA, 20 bp, Artificial
  CRISPR gRNA sequence
taagaatgcgtgccaggagt

SEQ ID NO: 814392 - DNA, 20 bp, Artificial
  CRISPR gRNA sequence
cttgtcagacaggtgacatt

SEQ ID NO: 814393 - DNA, 20 bp, Artificial
  CRISPR gRNA sequence
gtcagacaggtgacattttt

SEQ ID NO: 814394 - DNA, 20 bp, Artificial
  CRISPR gRNA sequence
tcagacaggtgacatttttc

SEQ ID NO: 814395 - DNA, 20 bp, Artificial
  CRISPR gRNA sequence
ttcagctaatatttacaaga

SEQ ID NO: 814396 - DNA, 20 bp, Artificial
  CRISPR gRNA sequence
tcagctaatatttacaagag

SEQ ID NO: 814397 - DNA, 20 bp, Artificial
  CRISPR gRNA sequence
cagctaatatttacaagaga

SEQ ID NO: 814398 - DNA, 20 bp, Artificial
  CRISPR gRNA sequence
agctaatatttacaagagaa

SEQ ID NO: 814399 - DNA, 20 bp, Artificial
  CRISPR gRNA sequence
atatttacaagagaaaagag

SEQ ID NO: 814400 - DNA, 20 bp, Artificial
  CRISPR gRNA sequence
acaagagaaaagagcaatta

SEQ ID NO: 814401 - DNA, 20 bp, Artificial
  CRISPR gRNA sequence
caagagaaaagagcaattag

SEQ ID NO: 814402 - DNA, 20 bp, Artificial
  CRISPR gRNA sequence
gcaaacatgaatcatatgtc

SEQ ID NO: 814403 - DNA, 20 bp, Artificial
  CRISPR gRNA sequence
aatagctcagaatacctaga

SEQ ID NO: 814404 - DNA, 20 bp, Artificial
  CRISPR gRNA sequence
agaatacctagaagattaat

SEQ ID NO: 814405 - DNA, 20 bp, Artificial
  CRISPR gRNA sequence
gaagattaattgttacttgg

SEQ ID NO: 814406 - DNA, 20 bp, Artificial
  CRISPR gRNA sequence
attgttacttggtctaattt

SEQ ID NO: 814407 - DNA, 20 bp, Artificial
  CRISPR gRNA sequence
ttacttggtctaattttgcc

SEQ ID NO: 814408 - DNA, 20 bp, Artificial
  CRISPR gRNA sequence
cttggtctaattttgcccca

SEQ ID NO: 814409 - DNA, 20 bp, Artificial
  CRISPR gRNA sequence
ggtctaattttgccccaagt

SEQ ID NO: 814410 - DNA, 20 bp, Artificial
  CRISPR gRNA sequence
gtctaattttgccccaagta

SEQ ID NO: 814411 - DNA, 20 bp, Artificial
  CRISPR gRNA sequence
attttgccccaagtaaagtt

SEQ ID NO: 814412 - DNA, 20 bp, Artificial
  CRISPR gRNA sequence
tgccccaagtaaagtttcta

SEQ ID NO: 814413 - DNA, 20 bp, Artificial
  CRISPR gRNA sequence
gccccaagtaaagtttctaa

SEQ ID NO: 814414 - DNA, 20 bp, Artificial
  CRISPR gRNA sequence
ccccaagtaaagtttctaag

SEQ ID NO: 814415 - DNA, 20 bp, Artificial
  CRISPR gRNA sequence
ctaagacatgcaaactttga

SEQ ID NO: 814416 - DNA, 20 bp, Artificial
  CRISPR gRNA sequence
taagacatgcaaactttgag

SEQ ID NO: 814417 - DNA, 20 bp, Artificial
  CRISPR gRNA sequence
agacatgcaaactttgagct

SEQ ID NO: 814418 - DNA, 20 bp, Artificial
  CRISPR gRNA sequence
tgagcttgattactccatac

SEQ ID NO: 814419 - DNA, 20 bp, Artificial
  CRISPR gRNA sequence
gagcttgattactccataca

SEQ ID NO: 814420 - DNA, 20 bp, Artificial
  CRISPR gRNA sequence
agcttgattactccatacaa

SEQ ID NO: 814421 - DNA, 20 bp, Artificial
  CRISPR gRNA sequence
gattactccatacaaaataa

SEQ ID NO: 814422 - DNA, 20 bp, Artificial
  CRISPR gRNA sequence
attactccatacaaaataag

SEQ ID NO: 814423 - DNA, 20 bp, Artificial
  CRISPR gRNA sequence
ctccatacaaaataagaggt

SEQ ID NO: 814424 - DNA, 20 bp, Artificial
  CRISPR gRNA sequence
catacaaaataagaggttta

SEQ ID NO: 814425 - DNA, 20 bp, Artificial
  CRISPR gRNA sequence
aggcaatgcaatagattttt

SEQ ID NO: 814426 - DNA, 20 bp, Artificial
  CRISPR gRNA sequence
ggcaatgcaatagatttttg

SEQ ID NO: 814427 - DNA, 20 bp, Artificial
  CRISPR gRNA sequence
ttgaaatcctgaaacattct

SEQ ID NO: 814428 - DNA, 20 bp, Artificial
  CRISPR gRNA sequence
tgaaatcctgaaacattctt

SEQ ID NO: 814429 - DNA, 20 bp, Artificial
  CRISPR gRNA sequence
gaaatcctgaaacattcttg

SEQ ID NO: 814430 - DNA, 20 bp, Artificial
  CRISPR gRNA sequence
aaatcctgaaacattcttgc

SEQ ID NO: 814431 - DNA, 20 bp, Artificial
  CRISPR gRNA sequence
aaacattcttgcttattgta

SEQ ID NO: 814432 - DNA, 20 bp, Artificial
  CRISPR gRNA sequence
ttgcttattgtaagttacag

SEQ ID NO: 814433 - DNA, 20 bp, Artificial
  CRISPR gRNA sequence
gcttattgtaagttacagag

SEQ ID NO: 814434 - DNA, 20 bp, Artificial
  CRISPR gRNA sequence
cttattgtaagttacagagg

SEQ ID NO: 814435 - DNA, 20 bp, Artificial
  CRISPR gRNA sequence
attgtaagttacagaggcaa

SEQ ID NO: 814436 - DNA, 20 bp, Artificial
  CRISPR gRNA sequence
ttgtaagttacagaggcaat

SEQ ID NO: 814437 - DNA, 20 bp, Artificial
  CRISPR gRNA sequence
taagttacagaggcaatcaa

SEQ ID NO: 814438 - DNA, 20 bp, Artificial
  CRISPR gRNA sequence
cagaggcaatcaagacactg

SEQ ID NO: 814439 - DNA, 20 bp, Artificial
  CRISPR gRNA sequence
atgcaaacaattctatgaag

SEQ ID NO: 814440 - DNA, 20 bp, Artificial
  CRISPR gRNA sequence
tatgaagaggttttttctca

SEQ ID NO: 814441 - DNA, 20 bp, Artificial
  CRISPR gRNA sequence
tgaagaggttttttctcaag

SEQ ID NO: 814442 - DNA, 20 bp, Artificial
  CRISPR gRNA sequence
tttctcaagcccagctgcaa

SEQ ID NO: 814443 - DNA, 20 bp, Artificial
  CRISPR gRNA sequence
ttctcaagcccagctgcaaa

SEQ ID NO: 814444 - DNA, 20 bp, Artificial
  CRISPR gRNA sequence
tctcaagcccagctgcaaat

SEQ ID NO: 814445 - DNA, 20 bp, Artificial
  CRISPR gRNA sequence
ctcaagcccagctgcaaatt

SEQ ID NO: 814446 - DNA, 20 bp, Artificial
  CRISPR gRNA sequence
tcaagcccagctgcaaatta

SEQ ID NO: 814447 - DNA, 20 bp, Artificial
  CRISPR gRNA sequence
aagcccagctgcaaattaga

SEQ ID NO: 814448 - DNA, 20 bp, Artificial
  CRISPR gRNA sequence
caaattagattcactaagca

SEQ ID NO: 814449 - DNA, 20 bp, Artificial
  CRISPR gRNA sequence
gattcactaagcagagggcc

SEQ ID NO: 814450 - DNA, 20 bp, Artificial
  CRISPR gRNA sequence
actaagcagagggcctcaat

SEQ ID NO: 814451 - DNA, 20 bp, Artificial
  CRISPR gRNA sequence
agcagagggcctcaatcttg

SEQ ID NO: 814452 - DNA, 20 bp, Artificial
  CRISPR gRNA sequence
aatcttggctaacattggaa

SEQ ID NO: 814453 - DNA, 20 bp, Artificial
  CRISPR gRNA sequence
ggctaacattggaatcacct

SEQ ID NO: 814454 - DNA, 20 bp, Artificial
  CRISPR gRNA sequence
gctaacattggaatcacctg

SEQ ID NO: 814455 - DNA, 20 bp, Artificial
  CRISPR gRNA sequence
acattggaatcacctgggag

SEQ ID NO: 814456 - DNA, 20 bp, Artificial
  CRISPR gRNA sequence
gaatcacctgggaggctttt

SEQ ID NO: 814457 - DNA, 20 bp, Artificial
  CRISPR gRNA sequence
ggaggcttttaaaacacact

SEQ ID NO: 814458 - DNA, 20 bp, Artificial
  CRISPR gRNA sequence
ttaaaacacactaatgccca

SEQ ID NO: 814459 - DNA, 20 bp, Artificial
  CRISPR gRNA sequence
taaaacacactaatgcccag

SEQ ID NO: 814460 - DNA, 20 bp, Artificial
  CRISPR gRNA sequence
aaaacacactaatgcccagg

SEQ ID NO: 814461 - DNA, 20 bp, Artificial
  CRISPR gRNA sequence
aaacacactaatgcccaggc

SEQ ID NO: 814462 - DNA, 20 bp, Artificial
  CRISPR gRNA sequence
atgcccaggcactactttgg

SEQ ID NO: 814463 - DNA, 20 bp, Artificial
  CRISPR gRNA sequence
ctttggatctgttaaaatta

SEQ ID NO: 814464 - DNA, 20 bp, Artificial
  CRISPR gRNA sequence
tggatctgttaaaattacat

SEQ ID NO: 814465 - DNA, 20 bp, Artificial
  CRISPR gRNA sequence
ggatctgttaaaattacatt

SEQ ID NO: 814466 - DNA, 20 bp, Artificial
  CRISPR gRNA sequence
gatctgttaaaattacatta

SEQ ID NO: 814467 - DNA, 20 bp, Artificial
  CRISPR gRNA sequence
ttaaaattacattattttgg

SEQ ID NO: 814468 - DNA, 20 bp, Artificial
  CRISPR gRNA sequence
aaattacattattttggaga

SEQ ID NO: 814469 - DNA, 20 bp, Artificial
  CRISPR gRNA sequence
cattattttggagatgaggt

SEQ ID NO: 814470 - DNA, 20 bp, Artificial
  CRISPR gRNA sequence
ttttggagatgaggtcagca

SEQ ID NO: 814471 - DNA, 20 bp, Artificial
  CRISPR gRNA sequence
tggagatgaggtcagcatca

SEQ ID NO: 814472 - DNA, 20 bp, Artificial
  CRISPR gRNA sequence
ggagatgaggtcagcatcat

SEQ ID NO: 814473 - DNA, 20 bp, Artificial
  CRISPR gRNA sequence
gagatgaggtcagcatcatt

SEQ ID NO: 814474 - DNA, 20 bp, Artificial
  CRISPR gRNA sequence
aagattttcttttcctggga

SEQ ID NO: 814475 - DNA, 20 bp, Artificial
  CRISPR gRNA sequence
tcttttcctgggagcttcta

SEQ ID NO: 814476 - DNA, 20 bp, Artificial
  CRISPR gRNA sequence
cttttcctgggagcttctaa

SEQ ID NO: 814477 - DNA, 20 bp, Artificial
  CRISPR gRNA sequence
ttttcctgggagcttctaaa

SEQ ID NO: 814478 - DNA, 20 bp, Artificial
  CRISPR gRNA sequence
ttcctgggagcttctaaagt

SEQ ID NO: 814479 - DNA, 20 bp, Artificial
  CRISPR gRNA sequence
tcctgggagcttctaaagtg

SEQ ID NO: 814480 - DNA, 20 bp, Artificial
  CRISPR gRNA sequence
cctgggagcttctaaagtgc

SEQ ID NO: 814481 - DNA, 20 bp, Artificial
  CRISPR gRNA sequence
ctgggagcttctaaagtgca

SEQ ID NO: 814482 - DNA, 20 bp, Artificial
  CRISPR gRNA sequence
ggagcttctaaagtgcagac

SEQ ID NO: 814483 - DNA, 20 bp, Artificial
  CRISPR gRNA sequence
ctaaagtgcagacagtattg

SEQ ID NO: 814484 - DNA, 20 bp, Artificial
  CRISPR gRNA sequence
taaagtgcagacagtattgc

SEQ ID NO: 814485 - DNA, 20 bp, Artificial
  CRISPR gRNA sequence
aagtgcagacagtattgcga

SEQ ID NO: 814486 - DNA, 20 bp, Artificial
  CRISPR gRNA sequence
cgaaccattagttacacaaa

SEQ ID NO: 814487 - DNA, 20 bp, Artificial
  CRISPR gRNA sequence
gttacacaaagtaacatttg

SEQ ID NO: 814488 - DNA, 20 bp, Artificial
  CRISPR gRNA sequence
cacaaagtaacatttgcacg

SEQ ID NO: 814489 - DNA, 20 bp, Artificial
  CRISPR gRNA sequence
gcacgtgcaagcgtctttta

SEQ ID NO: 814490 - DNA, 20 bp, Artificial
  CRISPR gRNA sequence
cacgtgcaagcgtcttttac

SEQ ID NO: 814491 - DNA, 20 bp, Artificial
  CRISPR gRNA sequence
ttaccaccttgccttcaaag

SEQ ID NO: 814492 - DNA, 20 bp, Artificial
  CRISPR gRNA sequence
taccaccttgccttcaaagt

SEQ ID NO: 814493 - DNA, 20 bp, Artificial
  CRISPR gRNA sequence
accaccttgccttcaaagtg

SEQ ID NO: 814494 - DNA, 20 bp, Artificial
  CRISPR gRNA sequence
ccaccttgccttcaaagtgt

SEQ ID NO: 814495 - DNA, 20 bp, Artificial
  CRISPR gRNA sequence
gccttcaaagtgttgtcctc

SEQ ID NO: 814496 - DNA, 20 bp, Artificial
  CRISPR gRNA sequence
ccttcaaagtgttgtcctca

SEQ ID NO: 814497 - DNA, 20 bp, Artificial
  CRISPR gRNA sequence
caaagtgttgtcctcaactt

SEQ ID NO: 814498 - DNA, 20 bp, Artificial
  CRISPR gRNA sequence
aaagtgttgtcctcaacttc

SEQ ID NO: 814499 - DNA, 20 bp, Artificial
  CRISPR gRNA sequence
tcctcaacttcacctggaag

SEQ ID NO: 814500 - DNA, 20 bp, Artificial
  CRISPR gRNA sequence
aacttcacctggaagctagg

SEQ ID NO: 814501 - DNA, 20 bp, Artificial
  CRISPR gRNA sequence
cacctggaagctaggtagaa

SEQ ID NO: 814502 - DNA, 20 bp, Artificial
  CRISPR gRNA sequence
acctggaagctaggtagaaa

SEQ ID NO: 814503 - DNA, 20 bp, Artificial
  CRISPR gRNA sequence
gaagctaggtagaaatgtag

SEQ ID NO: 814504 - DNA, 20 bp, Artificial
  CRISPR gRNA sequence
ggtagaaatgtagaatttca

SEQ ID NO: 814505 - DNA, 20 bp, Artificial
  CRISPR gRNA sequence
caagccttccccagacctag

SEQ ID NO: 814506 - DNA, 20 bp, Artificial
  CRISPR gRNA sequence
aagccttccccagacctagg

SEQ ID NO: 814507 - DNA, 20 bp, Artificial
  CRISPR gRNA sequence
ccccagacctagggaatcag

SEQ ID NO: 814508 - DNA, 20 bp, Artificial
  CRISPR gRNA sequence
cccagacctagggaatcagg

SEQ ID NO: 814509 - DNA, 20 bp, Artificial
  CRISPR gRNA sequence
gggaatcaggatctgcattt

SEQ ID NO: 814510 - DNA, 20 bp, Artificial
  CRISPR gRNA sequence
cattttaagaaggtcacggt

SEQ ID NO: 814511 - DNA, 20 bp, Artificial
  CRISPR gRNA sequence
taagaaggtcacggtgattt

SEQ ID NO: 814512 - DNA, 20 bp, Artificial
  CRISPR gRNA sequence
aagaaggtcacggtgatttg

SEQ ID NO: 814513 - DNA, 20 bp, Artificial
  CRISPR gRNA sequence
agaaggtcacggtgatttgc

SEQ ID NO: 814514 - DNA, 20 bp, Artificial
  CRISPR gRNA sequence
gcatgcacattaatgtttga

SEQ ID NO: 814515 - DNA, 20 bp, Artificial
  CRISPR gRNA sequence
catgcacattaatgtttgag

SEQ ID NO: 814516 - DNA, 20 bp, Artificial
  CRISPR gRNA sequence
atgtttgagaagtagagtta

SEQ ID NO: 814517 - DNA, 20 bp, Artificial
  CRISPR gRNA sequence
gagaagtagagttataacac

SEQ ID NO: 814518 - DNA, 20 bp, Artificial
  CRISPR gRNA sequence
agaagtagagttataacact

SEQ ID NO: 814519 - DNA, 20 bp, Artificial
  CRISPR gRNA sequence
taacactggtctgcatttgg

SEQ ID NO: 814520 - DNA, 20 bp, Artificial
  CRISPR gRNA sequence
gtctgcatttggactgtcac

SEQ ID NO: 814521 - DNA, 20 bp, Artificial
  CRISPR gRNA sequence
catttggactgtcactggga

SEQ ID NO: 814522 - DNA, 20 bp, Artificial
  CRISPR gRNA sequence
ggactgtcactgggaagtag

SEQ ID NO: 814523 - DNA, 20 bp, Artificial
  CRISPR gRNA sequence
gactgtcactgggaagtagc

SEQ ID NO: 814524 - DNA, 20 bp, Artificial
  CRISPR gRNA sequence
tcactgggaagtagcgtaat

SEQ ID NO: 814525 - DNA, 20 bp, Artificial
  CRISPR gRNA sequence
ggaagtagcgtaatagttga

SEQ ID NO: 814526 - DNA, 20 bp, Artificial
  CRISPR gRNA sequence
atatttcttaaacacagtaa

SEQ ID NO: 814527 - DNA, 20 bp, Artificial
  CRISPR gRNA sequence
cttaaacacagtaagtcaga

SEQ ID NO: 814528 - DNA, 20 bp, Artificial
  CRISPR gRNA sequence
ttaaacacagtaagtcagac

SEQ ID NO: 814529 - DNA, 20 bp, Artificial
  CRISPR gRNA sequence
aaacacagtaagtcagacac

SEQ ID NO: 814530 - DNA, 20 bp, Artificial
  CRISPR gRNA sequence
aacacagtaagtcagacact

SEQ ID NO: 814531 - DNA, 20 bp, Artificial
  CRISPR gRNA sequence
ggctagcccatcatttcatc

SEQ ID NO: 814532 - DNA, 20 bp, Artificial
  CRISPR gRNA sequence
gcccatcatttcatctgatc

SEQ ID NO: 814533 - DNA, 20 bp, Artificial
  CRISPR gRNA sequence
catctgatcctcccagcaac

SEQ ID NO: 814534 - DNA, 20 bp, Artificial
  CRISPR gRNA sequence
atctgatcctcccagcaact

SEQ ID NO: 814535 - DNA, 20 bp, Artificial
  CRISPR gRNA sequence
atcctcccagcaactctgcg

SEQ ID NO: 814536 - DNA, 20 bp, Artificial
  CRISPR gRNA sequence
ccagcaactctgcgaggtag

SEQ ID NO: 814537 - DNA, 20 bp, Artificial
  CRISPR gRNA sequence
tgcgaggtagatgttgctat

SEQ ID NO: 814538 - DNA, 20 bp, Artificial
  CRISPR gRNA sequence
cgaggtagatgttgctatcc

SEQ ID NO: 814539 - DNA, 20 bp, Artificial
  CRISPR gRNA sequence
ctatccacattttacagatg

SEQ ID NO: 814540 - DNA, 20 bp, Artificial
  CRISPR gRNA sequence
tccacattttacagatgggg

SEQ ID NO: 814541 - DNA, 20 bp, Artificial
  CRISPR gRNA sequence
tacagatggggaaactgagg

SEQ ID NO: 814542 - DNA, 20 bp, Artificial
  CRISPR gRNA sequence
acagatggggaaactgaggc

SEQ ID NO: 814543 - DNA, 20 bp, Artificial
  CRISPR gRNA sequence
cagatggggaaactgaggct

SEQ ID NO: 814544 - DNA, 20 bp, Artificial
  CRISPR gRNA sequence
aggctcaaagaagtgatgca

SEQ ID NO: 814545 - DNA, 20 bp, Artificial
  CRISPR gRNA sequence
aaagaagtgatgcaacttgc

SEQ ID NO: 814546 - DNA, 20 bp, Artificial
  CRISPR gRNA sequence
gcccaaggtcaaagaatggt

SEQ ID NO: 814547 - DNA, 20 bp, Artificial
  CRISPR gRNA sequence
cccaaggtcaaagaatggta

SEQ ID NO: 814548 - DNA, 20 bp, Artificial
  CRISPR gRNA sequence
atggaaccggaattcaaatt

SEQ ID NO: 814549 - DNA, 20 bp, Artificial
  CRISPR gRNA sequence
aaattcatctctgtgtcttc

SEQ ID NO: 814550 - DNA, 20 bp, Artificial
  CRISPR gRNA sequence
atctctgtgtcttcaatgca

SEQ ID NO: 814551 - DNA, 20 bp, Artificial
  CRISPR gRNA sequence
tgtgtcttcaatgcacattt

SEQ ID NO: 814552 - DNA, 20 bp, Artificial
  CRISPR gRNA sequence
tgtcttcaatgcacatttat

SEQ ID NO: 814553 - DNA, 20 bp, Artificial
  CRISPR gRNA sequence
caatgcacatttatttctgt

SEQ ID NO: 814554 - DNA, 20 bp, Artificial
  CRISPR gRNA sequence
aatgcacatttatttctgtg

SEQ ID NO: 814555 - DNA, 20 bp, Artificial
  CRISPR gRNA sequence
atttctgtgctaccaatgac

SEQ ID NO: 814556 - DNA, 20 bp, Artificial
  CRISPR gRNA sequence
tttctgtgctaccaatgact

SEQ ID NO: 814557 - DNA, 20 bp, Artificial
  CRISPR gRNA sequence
ctgtgctaccaatgactgca

SEQ ID NO: 814558 - DNA, 20 bp, Artificial
  CRISPR gRNA sequence
tgtgctaccaatgactgcag

SEQ ID NO: 814559 - DNA, 20 bp, Artificial
  CRISPR gRNA sequence
tgctaccaatgactgcagtt

SEQ ID NO: 814560 - DNA, 20 bp, Artificial
  CRISPR gRNA sequence
ccaatgactgcagttatgac

SEQ ID NO: 814561 - DNA, 20 bp, Artificial
  CRISPR gRNA sequence
cagttatgactatatatcca

SEQ ID NO: 814562 - DNA, 20 bp, Artificial
  CRISPR gRNA sequence
tgactatatatccactggca

SEQ ID NO: 814563 - DNA, 20 bp, Artificial
  CRISPR gRNA sequence
tatatccactggcatgtgta

SEQ ID NO: 814564 - DNA, 20 bp, Artificial
  CRISPR gRNA sequence
gcatgtgtacactacatcca

SEQ ID NO: 814565 - DNA, 20 bp, Artificial
  CRISPR gRNA sequence
catccatgagtgagtttttt

SEQ ID NO: 814566 - DNA, 20 bp, Artificial
  CRISPR gRNA sequence
tttttttttttttgctgtat

SEQ ID NO: 814567 - DNA, 20 bp, Artificial
  CRISPR gRNA sequence
ttttttttttttgctgtatg

SEQ ID NO: 814568 - DNA, 20 bp, Artificial
  CRISPR gRNA sequence
tttttttttttgctgtatgc

SEQ ID NO: 814569 - DNA, 20 bp, Artificial
  CRISPR gRNA sequence
ttttttttttgctgtatgct

SEQ ID NO: 814570 - DNA, 20 bp, Artificial
  CRISPR gRNA sequence
tttttttttgctgtatgcta

SEQ ID NO: 814571 - DNA, 20 bp, Artificial
  CRISPR gRNA sequence
ttttttttgctgtatgctaa

SEQ ID NO: 814572 - DNA, 20 bp, Artificial
  CRISPR gRNA sequence
tttttttgctgtatgctaag

SEQ ID NO: 814573 - DNA, 20 bp, Artificial
  CRISPR gRNA sequence
ttttttgctgtatgctaagg

SEQ ID NO: 814574 - DNA, 20 bp, Artificial
  CRISPR gRNA sequence
tttttgctgtatgctaagga

SEQ ID NO: 814575 - DNA, 20 bp, Artificial
  CRISPR gRNA sequence
ttttgctgtatgctaaggaa

SEQ ID NO: 814576 - DNA, 20 bp, Artificial
  CRISPR gRNA sequence
tttgctgtatgctaaggaaa

SEQ ID NO: 814577 - DNA, 20 bp, Artificial
  CRISPR gRNA sequence
ttgctgtatgctaaggaaaa

SEQ ID NO: 814578 - DNA, 20 bp, Artificial
  CRISPR gRNA sequence
tgctgtatgctaaggaaaag

SEQ ID NO: 814579 - DNA, 20 bp, Artificial
  CRISPR gRNA sequence
gctgtatgctaaggaaaaga

SEQ ID NO: 814580 - DNA, 20 bp, Artificial
  CRISPR gRNA sequence
ctgtatgctaaggaaaagat

SEQ ID NO: 814581 - DNA, 20 bp, Artificial
  CRISPR gRNA sequence
tatgctaaggaaaagatgtt

SEQ ID NO: 814582 - DNA, 20 bp, Artificial
  CRISPR gRNA sequence
aggaaaagatgttttgtttt

SEQ ID NO: 814583 - DNA, 20 bp, Artificial
  CRISPR gRNA sequence
tgttttctactttacatgcc

SEQ ID NO: 814584 - DNA, 20 bp, Artificial
  CRISPR gRNA sequence
gttttctactttacatgcca

SEQ ID NO: 814585 - DNA, 20 bp, Artificial
  CRISPR gRNA sequence
ttttctactttacatgccac

SEQ ID NO: 814586 - DNA, 20 bp, Artificial
  CRISPR gRNA sequence
tctactttacatgccacatg

SEQ ID NO: 814587 - DNA, 20 bp, Artificial
  CRISPR gRNA sequence
ctactttacatgccacatgg

SEQ ID NO: 814588 - DNA, 20 bp, Artificial
  CRISPR gRNA sequence
tactttacatgccacatggt

SEQ ID NO: 814589 - DNA, 20 bp, Artificial
  CRISPR gRNA sequence
ctttacatgccacatggtta

SEQ ID NO: 814590 - DNA, 20 bp, Artificial
  CRISPR gRNA sequence
tacatgccacatggttatta

SEQ ID NO: 814591 - DNA, 20 bp, Artificial
  CRISPR gRNA sequence
acatgccacatggttattaa

SEQ ID NO: 814592 - DNA, 20 bp, Artificial
  CRISPR gRNA sequence
catgccacatggttattaaa

SEQ ID NO: 814593 - DNA, 20 bp, Artificial
  CRISPR gRNA sequence
ttaaattaagcttcaaccta

SEQ ID NO: 814594 - DNA, 20 bp, Artificial
  CRISPR gRNA sequence
aattaagcttcaacctagga

SEQ ID NO: 814595 - DNA, 20 bp, Artificial
  CRISPR gRNA sequence
agcttcaacctaggattgaa

SEQ ID NO: 814596 - DNA, 20 bp, Artificial
  CRISPR gRNA sequence
caacctaggattgaactcct

SEQ ID NO: 814597 - DNA, 20 bp, Artificial
  CRISPR gRNA sequence
aacctaggattgaactcctg

SEQ ID NO: 814598 - DNA, 20 bp, Artificial
  CRISPR gRNA sequence
ggattgaactcctgaaggta

SEQ ID NO: 814599 - DNA, 20 bp, Artificial
  CRISPR gRNA sequence
aactcctgaaggtattagac

SEQ ID NO: 814600 - DNA, 20 bp, Artificial
  CRISPR gRNA sequence
ctgaaggtattagacaaagg

SEQ ID NO: 814601 - DNA, 20 bp, Artificial
  CRISPR gRNA sequence
aaggtattagacaaaggaga

SEQ ID NO: 814602 - DNA, 20 bp, Artificial
  CRISPR gRNA sequence
gacaaaggagaaaactggaa

SEQ ID NO: 814603 - DNA, 20 bp, Artificial
  CRISPR gRNA sequence
gaaggtttccacaactacaa

SEQ ID NO: 814604 - DNA, 20 bp, Artificial
  CRISPR gRNA sequence
ccacaactacaaaattaagc

SEQ ID NO: 814605 - DNA, 20 bp, Artificial
  CRISPR gRNA sequence
cacaactacaaaattaagct

SEQ ID NO: 814606 - DNA, 20 bp, Artificial
  CRISPR gRNA sequence
caaaattaagctgacaacac

SEQ ID NO: 814607 - DNA, 20 bp, Artificial
  CRISPR gRNA sequence
agctgacaacacaggctttc

SEQ ID NO: 814608 - DNA, 20 bp, Artificial
  CRISPR gRNA sequence
acaacacaggctttccattc

SEQ ID NO: 814609 - DNA, 20 bp, Artificial
  CRISPR gRNA sequence
tccattcatgtggggccctt

SEQ ID NO: 814610 - DNA, 20 bp, Artificial
  CRISPR gRNA sequence
ccattcatgtggggccctta

SEQ ID NO: 814611 - DNA, 20 bp, Artificial
  CRISPR gRNA sequence
cattcatgtggggcccttaa

SEQ ID NO: 814612 - DNA, 20 bp, Artificial
  CRISPR gRNA sequence
atgtggggcccttaactaaa

SEQ ID NO: 814613 - DNA, 20 bp, Artificial
  CRISPR gRNA sequence
aactaaactaaagggcaaaa

SEQ ID NO: 814614 - DNA, 20 bp, Artificial
  CRISPR gRNA sequence
actaaactaaagggcaaaag

SEQ ID NO: 814615 - DNA, 20 bp, Artificial
  CRISPR gRNA sequence
aactaaagggcaaaagactt

SEQ ID NO: 814616 - DNA, 20 bp, Artificial
  CRISPR gRNA sequence
aagggcaaaagacttggcaa

SEQ ID NO: 814617 - DNA, 20 bp, Artificial
  CRISPR gRNA sequence
ggcaaaagcatgaaaaattc

SEQ ID NO: 814618 - DNA, 20 bp, Artificial
  CRISPR gRNA sequence
gcaaaagcatgaaaaattca

SEQ ID NO: 814619 - DNA, 20 bp, Artificial
  CRISPR gRNA sequence
atgtatgcaggtccttttgc

SEQ ID NO: 814620 - DNA, 20 bp, Artificial
  CRISPR gRNA sequence
ttgctagattagaacaccta

SEQ ID NO: 814621 - DNA, 20 bp, Artificial
  CRISPR gRNA sequence
tgctagattagaacacctag

SEQ ID NO: 814622 - DNA, 20 bp, Artificial
  CRISPR gRNA sequence
gctagattagaacacctagc

SEQ ID NO: 814623 - DNA, 20 bp, Artificial
  CRISPR gRNA sequence
ctagattagaacacctagct

SEQ ID NO: 814624 - DNA, 20 bp, Artificial
  CRISPR gRNA sequence
gattagaacacctagcttga

SEQ ID NO: 814625 - DNA, 20 bp, Artificial
  CRISPR gRNA sequence
gaacacctagcttgatgcat

SEQ ID NO: 814626 - DNA, 20 bp, Artificial
  CRISPR gRNA sequence
gcttgatgcatttcaaaaat

SEQ ID NO: 814627 - DNA, 20 bp, Artificial
  CRISPR gRNA sequence
gatgcatttcaaaaattctt

SEQ ID NO: 814628 - DNA, 20 bp, Artificial
  CRISPR gRNA sequence
atgcatttcaaaaattcttg

SEQ ID NO: 814629 - DNA, 20 bp, Artificial
  CRISPR gRNA sequence
caaaaattcttgggggagct

SEQ ID NO: 814630 - DNA, 20 bp, Artificial
  CRISPR gRNA sequence
aaaaattcttgggggagctt

SEQ ID NO: 814631 - DNA, 20 bp, Artificial
  CRISPR gRNA sequence
ttgggggagctttgcatttt

SEQ ID NO: 814632 - DNA, 20 bp, Artificial
  CRISPR gRNA sequence
gggggagctttgcattttat

SEQ ID NO: 814633 - DNA, 20 bp, Artificial
  CRISPR gRNA sequence
ggggagctttgcattttatt

SEQ ID NO: 814634 - DNA, 20 bp, Artificial
  CRISPR gRNA sequence
tgcattttattgcaatgaag

SEQ ID NO: 814635 - DNA, 20 bp, Artificial
  CRISPR gRNA sequence
gcattttattgcaatgaagc

SEQ ID NO: 814636 - DNA, 20 bp, Artificial
  CRISPR gRNA sequence
cattttattgcaatgaagca

SEQ ID NO: 814637 - DNA, 20 bp, Artificial
  CRISPR gRNA sequence
tattgcaatgaagcatcaat

SEQ ID NO: 814638 - DNA, 20 bp, Artificial
  CRISPR gRNA sequence
attgcaatgaagcatcaatg

SEQ ID NO: 814639 - DNA, 20 bp, Artificial
  CRISPR gRNA sequence
ttgcaatgaagcatcaatgg

SEQ ID NO: 814640 - DNA, 20 bp, Artificial
  CRISPR gRNA sequence
caatgaagcatcaatggtag

SEQ ID NO: 814641 - DNA, 20 bp, Artificial
  CRISPR gRNA sequence
tcacttattcaggaaacaca

SEQ ID NO: 814642 - DNA, 20 bp, Artificial
  CRISPR gRNA sequence
attcaggaaacacacaacga

SEQ ID NO: 814643 - DNA, 20 bp, Artificial
  CRISPR gRNA sequence
ttcaggaaacacacaacgaa

SEQ ID NO: 814644 - DNA, 20 bp, Artificial
  CRISPR gRNA sequence
aggaaacacacaacgaatta

SEQ ID NO: 814645 - DNA, 20 bp, Artificial
  CRISPR gRNA sequence
tttgcattacctcccaagat

SEQ ID NO: 814646 - DNA, 20 bp, Artificial
  CRISPR gRNA sequence
gcattacctcccaagatagc

SEQ ID NO: 814647 - DNA, 20 bp, Artificial
  CRISPR gRNA sequence
cattacctcccaagatagct

SEQ ID NO: 814648 - DNA, 20 bp, Artificial
  CRISPR gRNA sequence
cctcccaagatagcttcctc

SEQ ID NO: 814649 - DNA, 20 bp, Artificial
  CRISPR gRNA sequence
ccaagatagcttcctcttga

SEQ ID NO: 814650 - DNA, 20 bp, Artificial
  CRISPR gRNA sequence
cctcttgaaactaagtttat

SEQ ID NO: 814651 - DNA, 20 bp, Artificial
  CRISPR gRNA sequence
ctcttgaaactaagtttata

SEQ ID NO: 814652 - DNA, 20 bp, Artificial
  CRISPR gRNA sequence
ttgaaactaagtttatattt

SEQ ID NO: 814653 - DNA, 20 bp, Artificial
  CRISPR gRNA sequence
gaaactaagtttatatttta

SEQ ID NO: 814654 - DNA, 20 bp, Artificial
  CRISPR gRNA sequence
aaactaagtttatattttat

SEQ ID NO: 814655 - DNA, 20 bp, Artificial
  CRISPR gRNA sequence
agtttatattttatccccca

SEQ ID NO: 814656 - DNA, 20 bp, Artificial
  CRISPR gRNA sequence
atattttatcccccacattt

SEQ ID NO: 814657 - DNA, 20 bp, Artificial
  CRISPR gRNA sequence
tattttatcccccacattta

SEQ ID NO: 814658 - DNA, 20 bp, Artificial
  CRISPR gRNA sequence
tatcccccacatttaacaac

SEQ ID NO: 814659 - DNA, 20 bp, Artificial
  CRISPR gRNA sequence
atcccccacatttaacaaca

SEQ ID NO: 814660 - DNA, 20 bp, Artificial
  CRISPR gRNA sequence
tcccccacatttaacaacag

SEQ ID NO: 814661 - DNA, 20 bp, Artificial
  CRISPR gRNA sequence
aacaacagaagtgtaagttt

SEQ ID NO: 814662 - DNA, 20 bp, Artificial
  CRISPR gRNA sequence
acaacagaagtgtaagtttt

SEQ ID NO: 814663 - DNA, 20 bp, Artificial
  CRISPR gRNA sequence
tttcagacttgccacgtaat

SEQ ID NO: 814664 - DNA, 20 bp, Artificial
  CRISPR gRNA sequence
ttcagacttgccacgtaatg

SEQ ID NO: 814665 - DNA, 20 bp, Artificial
  CRISPR gRNA sequence
tcagacttgccacgtaatgt

SEQ ID NO: 814666 - DNA, 20 bp, Artificial
  CRISPR gRNA sequence
cagacttgccacgtaatgta

SEQ ID NO: 814667 - DNA, 20 bp, Artificial
  CRISPR gRNA sequence
agacttgccacgtaatgtac

SEQ ID NO: 814668 - DNA, 20 bp, Artificial
  CRISPR gRNA sequence
gccacgtaatgtacttgaga

SEQ ID NO: 814669 - DNA, 20 bp, Artificial
  CRISPR gRNA sequence
ccacgtaatgtacttgagaa

SEQ ID NO: 814670 - DNA, 20 bp, Artificial
  CRISPR gRNA sequence
gagaagtaagggtggggtgg

SEQ ID NO: 814671 - DNA, 20 bp, Artificial
  CRISPR gRNA sequence
agaagtaagggtggggtggg

SEQ ID NO: 814672 - DNA, 20 bp, Artificial
  CRISPR gRNA sequence
tacatagccacattcttcag

SEQ ID NO: 814673 - DNA, 20 bp, Artificial
  CRISPR gRNA sequence
acatagccacattcttcaga

SEQ ID NO: 814674 - DNA, 20 bp, Artificial
  CRISPR gRNA sequence
catagccacattcttcagaa

SEQ ID NO: 814675 - DNA, 20 bp, Artificial
  CRISPR gRNA sequence
ttcagaaaactctgaagttc

SEQ ID NO: 814676 - DNA, 20 bp, Artificial
  CRISPR gRNA sequence
cagaaaactctgaagttcct

SEQ ID NO: 814677 - DNA, 20 bp, Artificial
  CRISPR gRNA sequence
agaaaactctgaagttcctg

SEQ ID NO: 814678 - DNA, 20 bp, Artificial
  CRISPR gRNA sequence
tgaagttcctggtttaggac

SEQ ID NO: 814679 - DNA, 20 bp, Artificial
  CRISPR gRNA sequence
aagttcctggtttaggacaa

SEQ ID NO: 814680 - DNA, 20 bp, Artificial
  CRISPR gRNA sequence
ctggtttaggacaaaatcct

SEQ ID NO: 814681 - DNA, 20 bp, Artificial
  CRISPR gRNA sequence
gtttaggacaaaatcctgct

SEQ ID NO: 814682 - DNA, 20 bp, Artificial
  CRISPR gRNA sequence
aggacaaaatcctgctctaa

SEQ ID NO: 814683 - DNA, 20 bp, Artificial
  CRISPR gRNA sequence
ggacaaaatcctgctctaag

SEQ ID NO: 814684 - DNA, 20 bp, Artificial
  CRISPR gRNA sequence
ctctaagcacctgactcatg

SEQ ID NO: 814685 - DNA, 20 bp, Artificial
  CRISPR gRNA sequence
taagcacctgactcatgctc

SEQ ID NO: 814686 - DNA, 20 bp, Artificial
  CRISPR gRNA sequence
agcacctgactcatgctctg

SEQ ID NO: 814687 - DNA, 20 bp, Artificial
  CRISPR gRNA sequence
actcatgctctgctcagtgt

SEQ ID NO: 814688 - DNA, 20 bp, Artificial
  CRISPR gRNA sequence
atgctctgctcagtgtagga

SEQ ID NO: 814689 - DNA, 20 bp, Artificial
  CRISPR gRNA sequence
tgctcagtgtaggaggactg

SEQ ID NO: 814690 - DNA, 20 bp, Artificial
  CRISPR gRNA sequence
ctcagtgtaggaggactgca

SEQ ID NO: 814691 - DNA, 20 bp, Artificial
  CRISPR gRNA sequence
agtgtaggaggactgcatgg

SEQ ID NO: 814692 - DNA, 20 bp, Artificial
  CRISPR gRNA sequence
catggagacatgtcttcgca

SEQ ID NO: 814693 - DNA, 20 bp, Artificial
  CRISPR gRNA sequence
cgcatagaaatcctttcccc

SEQ ID NO: 814694 - DNA, 20 bp, Artificial
  CRISPR gRNA sequence
gcatagaaatcctttcccca

SEQ ID NO: 814695 - DNA, 20 bp, Artificial
  CRISPR gRNA sequence
tccccaacctgattattctc

SEQ ID NO: 814696 - DNA, 20 bp, Artificial
  CRISPR gRNA sequence
ccccaacctgattattctcc

SEQ ID NO: 814697 - DNA, 20 bp, Artificial
  CRISPR gRNA sequence
cccaacctgattattctcct

SEQ ID NO: 814698 - DNA, 20 bp, Artificial
  CRISPR gRNA sequence
attattctcctttgtttatc

SEQ ID NO: 814699 - DNA, 20 bp, Artificial
  CRISPR gRNA sequence
ttctcctttgtttatctcag

SEQ ID NO: 814700 - DNA, 20 bp, Artificial
  CRISPR gRNA sequence
tcctttgtttatctcagcag

SEQ ID NO: 814701 - DNA, 20 bp, Artificial
  CRISPR gRNA sequence
ctttgtttatctcagcagtc

SEQ ID NO: 814702 - DNA, 20 bp, Artificial
  CRISPR gRNA sequence
tgtttatctcagcagtcagc

SEQ ID NO: 814703 - DNA, 20 bp, Artificial
  CRISPR gRNA sequence
gtttatctcagcagtcagca

SEQ ID NO: 814704 - DNA, 20 bp, Artificial
  CRISPR gRNA sequence
tttatctcagcagtcagcag

SEQ ID NO: 814705 - DNA, 20 bp, Artificial
  CRISPR gRNA sequence
atctcagcagtcagcagggt

SEQ ID NO: 814706 - DNA, 20 bp, Artificial
  CRISPR gRNA sequence
tctcagcagtcagcagggta

SEQ ID NO: 814707 - DNA, 20 bp, Artificial
  CRISPR gRNA sequence
agcagtcagcagggtagttt

SEQ ID NO: 814708 - DNA, 20 bp, Artificial
  CRISPR gRNA sequence
tggatctaaagataggcgaa

SEQ ID NO: 814709 - DNA, 20 bp, Artificial
  CRISPR gRNA sequence
ggatctaaagataggcgaag

SEQ ID NO: 814710 - DNA, 20 bp, Artificial
  CRISPR gRNA sequence
gatctaaagataggcgaagt

SEQ ID NO: 814711 - DNA, 20 bp, Artificial
  CRISPR gRNA sequence
aagataggcgaagtggagta

SEQ ID NO: 814712 - DNA, 20 bp, Artificial
  CRISPR gRNA sequence
ggctgaggtctgtgccccag

SEQ ID NO: 814713 - DNA, 20 bp, Artificial
  CRISPR gRNA sequence
aggtctgtgccccagaatga

SEQ ID NO: 814714 - DNA, 20 bp, Artificial
  CRISPR gRNA sequence
tgccccagaatgacctcagg

SEQ ID NO: 814715 - DNA, 20 bp, Artificial
  CRISPR gRNA sequence
aggcatcaccatggtcattg

SEQ ID NO: 814716 - DNA, 20 bp, Artificial
  CRISPR gRNA sequence
tggccctctggttttcatct

SEQ ID NO: 814717 - DNA, 20 bp, Artificial
  CRISPR gRNA sequence
tggttttcatctacctctgg

SEQ ID NO: 814718 - DNA, 20 bp, Artificial
  CRISPR gRNA sequence
gttttcatctacctctggag

SEQ ID NO: 814719 - DNA, 20 bp, Artificial
  CRISPR gRNA sequence
tcatctacctctggagtacg

SEQ ID NO: 814720 - DNA, 20 bp, Artificial
  CRISPR gRNA sequence
catctacctctggagtacga

SEQ ID NO: 814721 - DNA, 20 bp, Artificial
  CRISPR gRNA sequence
atctacctctggagtacgaa

SEQ ID NO: 814722 - DNA, 20 bp, Artificial
  CRISPR gRNA sequence
cctctggagtacgaagagag

SEQ ID NO: 814723 - DNA, 20 bp, Artificial
  CRISPR gRNA sequence
tggagtacgaagagagaaga

SEQ ID NO: 814724 - DNA, 20 bp, Artificial
  CRISPR gRNA sequence
gagtacgaagagagaagaaa

SEQ ID NO: 814725 - DNA, 20 bp, Artificial
  CRISPR gRNA sequence
gggtggctctttcctctaag

SEQ ID NO: 814726 - DNA, 20 bp, Artificial
  CRISPR gRNA sequence
tttcctctaagacatgacaa

SEQ ID NO: 814727 - DNA, 20 bp, Artificial
  CRISPR gRNA sequence
tcctctaagacatgacaagg

SEQ ID NO: 814728 - DNA, 20 bp, Artificial
  CRISPR gRNA sequence
cctctaagacatgacaaggt

SEQ ID NO: 814729 - DNA, 20 bp, Artificial
  CRISPR gRNA sequence
ctctaagacatgacaaggta

SEQ ID NO: 814730 - DNA, 20 bp, Artificial
  CRISPR gRNA sequence
taagacatgacaaggtataa

SEQ ID NO: 814731 - DNA, 20 bp, Artificial
  CRISPR gRNA sequence
agacatgacaaggtataaaa

SEQ ID NO: 814732 - DNA, 20 bp, Artificial
  CRISPR gRNA sequence
ctgggttataagatgtcctt

SEQ ID NO: 814733 - DNA, 20 bp, Artificial
  CRISPR gRNA sequence
tgggttataagatgtcctta

SEQ ID NO: 814734 - DNA, 20 bp, Artificial
  CRISPR gRNA sequence
ggttataagatgtccttaga

SEQ ID NO: 814735 - DNA, 20 bp, Artificial
  CRISPR gRNA sequence
taagatgtccttagattttg

SEQ ID NO: 814736 - DNA, 20 bp, Artificial
  CRISPR gRNA sequence
agattttgaaataaaaatgt

SEQ ID NO: 814737 - DNA, 20 bp, Artificial
  CRISPR gRNA sequence
gattttgaaataaaaatgta

SEQ ID NO: 814738 - DNA, 20 bp, Artificial
  CRISPR gRNA sequence
tgaaataaaaatgtaagaaa

SEQ ID NO: 814739 - DNA, 20 bp, Artificial
  CRISPR gRNA sequence
gaaataaaaatgtaagaaaa

SEQ ID NO: 814740 - DNA, 20 bp, Artificial
  CRISPR gRNA sequence
aaataaaaatgtaagaaaaa

SEQ ID NO: 814741 - DNA, 20 bp, Artificial
  CRISPR gRNA sequence
gcaaaaggatatacacataa

SEQ ID NO: 814742 - DNA, 20 bp, Artificial
  CRISPR gRNA sequence
caaaaggatatacacataag

SEQ ID NO: 814743 - DNA, 20 bp, Artificial
  CRISPR gRNA sequence
atggaacaaaaagtccagaa

SEQ ID NO: 814744 - DNA, 20 bp, Artificial
  CRISPR gRNA sequence
attgattttgatgaagattc

SEQ ID NO: 814745 - DNA, 20 bp, Artificial
  CRISPR gRNA sequence
attttgatgaagattcaaag

SEQ ID NO: 814746 - DNA, 20 bp, Artificial
  CRISPR gRNA sequence
tgatgaagattcaaaggcta

SEQ ID NO: 814747 - DNA, 20 bp, Artificial
  CRISPR gRNA sequence
gatgaagattcaaaggctat

SEQ ID NO: 814748 - DNA, 20 bp, Artificial
  CRISPR gRNA sequence
atgaagattcaaaggctatt

SEQ ID NO: 814749 - DNA, 20 bp, Artificial
  CRISPR gRNA sequence
aaaggctattgaatggggaa

SEQ ID NO: 814750 - DNA, 20 bp, Artificial
  CRISPR gRNA sequence
ttgaatggggaaaggatggg

SEQ ID NO: 814751 - DNA, 20 bp, Artificial
  CRISPR gRNA sequence
aatggggaaaggatgggtgt

SEQ ID NO: 814752 - DNA, 20 bp, Artificial
  CRISPR gRNA sequence
tttaacaaatggggctggaa

SEQ ID NO: 814753 - DNA, 20 bp, Artificial
  CRISPR gRNA sequence
ttaacaaatggggctggaac

SEQ ID NO: 814754 - DNA, 20 bp, Artificial
  CRISPR gRNA sequence
taacaaatggggctggaaca

SEQ ID NO: 814755 - DNA, 20 bp, Artificial
  CRISPR gRNA sequence
aacaaatggggctggaacaa

SEQ ID NO: 814756 - DNA, 20 bp, Artificial
  CRISPR gRNA sequence
acaaatggggctggaacaac

SEQ ID NO: 814757 - DNA, 20 bp, Artificial
  CRISPR gRNA sequence
gaacaactgaacatctacat

SEQ ID NO: 814758 - DNA, 20 bp, Artificial
  CRISPR gRNA sequence
aacatctacatgtaaaacta

SEQ ID NO: 814759 - DNA, 20 bp, Artificial
  CRISPR gRNA sequence
catgtaaaactaaaatgagc

SEQ ID NO: 814760 - DNA, 20 bp, Artificial
  CRISPR gRNA sequence
aaatgagcttaacctataca

SEQ ID NO: 814761 - DNA, 20 bp, Artificial
  CRISPR gRNA sequence
aacctatacatcacacctta

SEQ ID NO: 814762 - DNA, 20 bp, Artificial
  CRISPR gRNA sequence
acctatacatcacaccttat

SEQ ID NO: 814763 - DNA, 20 bp, Artificial
  CRISPR gRNA sequence
tacatcacaccttatataaa

SEQ ID NO: 814764 - DNA, 20 bp, Artificial
  CRISPR gRNA sequence
atataaaaattaaaatggat

SEQ ID NO: 814765 - DNA, 20 bp, Artificial
  CRISPR gRNA sequence
tataaaaattaaaatggatt

SEQ ID NO: 814766 - DNA, 20 bp, Artificial
  CRISPR gRNA sequence
aaatggattataaaccttac

SEQ ID NO: 814767 - DNA, 20 bp, Artificial
  CRISPR gRNA sequence
taaaccttacatatagaata

SEQ ID NO: 814768 - DNA, 20 bp, Artificial
  CRISPR gRNA sequence
acatatagaatatacaacta

SEQ ID NO: 814769 - DNA, 20 bp, Artificial
  CRISPR gRNA sequence
catatagaatatacaactac

SEQ ID NO: 814770 - DNA, 20 bp, Artificial
  CRISPR gRNA sequence
caaaatgtgtagaagaaaat

SEQ ID NO: 814771 - DNA, 20 bp, Artificial
  CRISPR gRNA sequence
ttacatcttgggttatgtaa

SEQ ID NO: 814772 - DNA, 20 bp, Artificial
  CRISPR gRNA sequence
tacatcttgggttatgtaaa

SEQ ID NO: 814773 - DNA, 20 bp, Artificial
  CRISPR gRNA sequence
acatcttgggttatgtaaag

SEQ ID NO: 814774 - DNA, 20 bp, Artificial
  CRISPR gRNA sequence
catcttgggttatgtaaaga

SEQ ID NO: 814775 - DNA, 20 bp, Artificial
  CRISPR gRNA sequence
gggttatgtaaagagttttt

SEQ ID NO: 814776 - DNA, 20 bp, Artificial
  CRISPR gRNA sequence
ggttatgtaaagagtttttg

SEQ ID NO: 814777 - DNA, 20 bp, Artificial
  CRISPR gRNA sequence
tgtaaagagtttttggatat

SEQ ID NO: 814778 - DNA, 20 bp, Artificial
  CRISPR gRNA sequence
ttggatatgataccaaaagc

SEQ ID NO: 814779 - DNA, 20 bp, Artificial
  CRISPR gRNA sequence
tggatatgataccaaaagca

SEQ ID NO: 814780 - DNA, 20 bp, Artificial
  CRISPR gRNA sequence
ggatatgataccaaaagcat

SEQ ID NO: 814781 - DNA, 20 bp, Artificial
  CRISPR gRNA sequence
gatatgataccaaaagcatg

SEQ ID NO: 814782 - DNA, 20 bp, Artificial
  CRISPR gRNA sequence
ataaatcaaacttcatcaaa

SEQ ID NO: 814783 - DNA, 20 bp, Artificial
  CRISPR gRNA sequence
catcaaaattaaaatctttg

SEQ ID NO: 814784 - DNA, 20 bp, Artificial
  CRISPR gRNA sequence
atcaaaattaaaatctttgc

SEQ ID NO: 814785 - DNA, 20 bp, Artificial
  CRISPR gRNA sequence
aaatctttgctctgcaaaag

SEQ ID NO: 814786 - DNA, 20 bp, Artificial
  CRISPR gRNA sequence
tgctctgcaaaagacacagt

SEQ ID NO: 814787 - DNA, 20 bp, Artificial
  CRISPR gRNA sequence
gctctgcaaaagacacagtt

SEQ ID NO: 814788 - DNA, 20 bp, Artificial
  CRISPR gRNA sequence
ctctgcaaaagacacagtta

SEQ ID NO: 814789 - DNA, 20 bp, Artificial
  CRISPR gRNA sequence
tgcaaaagacacagttaaga

SEQ ID NO: 814790 - DNA, 20 bp, Artificial
  CRISPR gRNA sequence
caaaagacacagttaagaaa

SEQ ID NO: 814791 - DNA, 20 bp, Artificial
  CRISPR gRNA sequence
agaaaatgaaaagacaagct

SEQ ID NO: 814792 - DNA, 20 bp, Artificial
  CRISPR gRNA sequence
cagacttcaaaagaatattt

SEQ ID NO: 814793 - DNA, 20 bp, Artificial
  CRISPR gRNA sequence
caaaagaatatttgaaaatc

SEQ ID NO: 814794 - DNA, 20 bp, Artificial
  CRISPR gRNA sequence
aaaagaatatttgaaaatca

SEQ ID NO: 814795 - DNA, 20 bp, Artificial
  CRISPR gRNA sequence
gaaaatcaatatctgataaa

SEQ ID NO: 814796 - DNA, 20 bp, Artificial
  CRISPR gRNA sequence
aaaatcaatatctgataaag

SEQ ID NO: 814797 - DNA, 20 bp, Artificial
  CRISPR gRNA sequence
ataaagaacttgtatctaga

SEQ ID NO: 814798 - DNA, 20 bp, Artificial
  CRISPR gRNA sequence
gtatctagaataaagaactc

SEQ ID NO: 814799 - DNA, 20 bp, Artificial
  CRISPR gRNA sequence
tatctagaataaagaactct

SEQ ID NO: 814800 - DNA, 20 bp, Artificial
  CRISPR gRNA sequence
gaataaagaactcttaaggt

SEQ ID NO: 814801 - DNA, 20 bp, Artificial
  CRISPR gRNA sequence
ttaaggtcgtggcagtggct

SEQ ID NO: 814802 - DNA, 20 bp, Artificial
  CRISPR gRNA sequence
aaggtcgtggcagtggctca

SEQ ID NO: 814803 - DNA, 20 bp, Artificial
  CRISPR gRNA sequence
aggtcgtggcagtggctcac

SEQ ID NO: 814804 - DNA, 20 bp, Artificial
  CRISPR gRNA sequence
acacctgtaatcccagcact

SEQ ID NO: 814805 - DNA, 20 bp, Artificial
  CRISPR gRNA sequence
taatcccagcactttgggag

SEQ ID NO: 814806 - DNA, 20 bp, Artificial
  CRISPR gRNA sequence
tgggaggccaaggtgggtgg

SEQ ID NO: 814807 - DNA, 20 bp, Artificial
  CRISPR gRNA sequence
gggaggccaaggtgggtggg

SEQ ID NO: 814808 - DNA, 20 bp, Artificial
  CRISPR gRNA sequence
ggaggccaaggtgggtgggc

SEQ ID NO: 814809 - DNA, 20 bp, Artificial
  CRISPR gRNA sequence
gaggtcagaagcttgagaca

SEQ ID NO: 814810 - DNA, 20 bp, Artificial
  CRISPR gRNA sequence
aggtcagaagcttgagacag

SEQ ID NO: 814811 - DNA, 20 bp, Artificial
  CRISPR gRNA sequence
gagacagcctggccaacata

SEQ ID NO: 814812 - DNA, 20 bp, Artificial
  CRISPR gRNA sequence
agacagcctggccaacatag

SEQ ID NO: 814813 - DNA, 20 bp, Artificial
  CRISPR gRNA sequence
gccaacatagtgaaaccccg

SEQ ID NO: 814814 - DNA, 20 bp, Artificial
  CRISPR gRNA sequence
tactgaaaatacaaacataa

SEQ ID NO: 814815 - DNA, 20 bp, Artificial
  CRISPR gRNA sequence
ctgaaaatacaaacataagc

SEQ ID NO: 814816 - DNA, 20 bp, Artificial
  CRISPR gRNA sequence
aaaatacaaacataagccaa

SEQ ID NO: 814817 - DNA, 20 bp, Artificial
  CRISPR gRNA sequence
taattccagccagtcaagag

SEQ ID NO: 814818 - DNA, 20 bp, Artificial
  CRISPR gRNA sequence
cagccagtcaagaggctgag

SEQ ID NO: 814819 - DNA, 20 bp, Artificial
  CRISPR gRNA sequence
aggctggagaatcgcttaaa

SEQ ID NO: 814820 - DNA, 20 bp, Artificial
  CRISPR gRNA sequence
gagaatcgcttaaacttggg

SEQ ID NO: 814821 - DNA, 20 bp, Artificial
  CRISPR gRNA sequence
aaacttgggaggcagaggct

SEQ ID NO: 814822 - DNA, 20 bp, Artificial
  CRISPR gRNA sequence
aacttgggaggcagaggctg

SEQ ID NO: 814823 - DNA, 20 bp, Artificial
  CRISPR gRNA sequence
gggaggcagaggctgtagtg

SEQ ID NO: 814824 - DNA, 20 bp, Artificial
  CRISPR gRNA sequence
ggaggcagaggctgtagtga

SEQ ID NO: 814825 - DNA, 20 bp, Artificial
  CRISPR gRNA sequence
tagtgagccacgacagtgaa

SEQ ID NO: 814826 - DNA, 20 bp, Artificial
  CRISPR gRNA sequence
cagcctgggcgactgatgga

SEQ ID NO: 814827 - DNA, 20 bp, Artificial
  CRISPR gRNA sequence
ggcgactgatggagactgcg

SEQ ID NO: 814828 - DNA, 20 bp, Artificial
  CRISPR gRNA sequence
atggagactgcgtctcaaaa

SEQ ID NO: 814829 - DNA, 20 bp, Artificial
  CRISPR gRNA sequence
cgtctcaaaaaaatagagaa

SEQ ID NO: 814830 - DNA, 20 bp, Artificial
  CRISPR gRNA sequence
aaaaaaatagagaattttta

SEQ ID NO: 814831 - DNA, 20 bp, Artificial
  CRISPR gRNA sequence
ttaaaaccttacaataagaa

SEQ ID NO: 814832 - DNA, 20 bp, Artificial
  CRISPR gRNA sequence
taaaaccttacaataagaaa

SEQ ID NO: 814833 - DNA, 20 bp, Artificial
  CRISPR gRNA sequence
aaaaccttacaataagaaaa

SEQ ID NO: 814834 - DNA, 20 bp, Artificial
  CRISPR gRNA sequence
aaaccttacaataagaaaat

SEQ ID NO: 814835 - DNA, 20 bp, Artificial
  CRISPR gRNA sequence
acaataagaaaataaacaat

SEQ ID NO: 814836 - DNA, 20 bp, Artificial
  CRISPR gRNA sequence
caataagaaaataaacaata

SEQ ID NO: 814837 - DNA, 20 bp, Artificial
  CRISPR gRNA sequence
aacaatcgtttaattcctta

SEQ ID NO: 814838 - DNA, 20 bp, Artificial
  CRISPR gRNA sequence
aattccttagtatacaatta

SEQ ID NO: 814839 - DNA, 20 bp, Artificial
  CRISPR gRNA sequence
attccttagtatacaattac

SEQ ID NO: 814840 - DNA, 20 bp, Artificial
  CRISPR gRNA sequence
cttagtatacaattacaaag

SEQ ID NO: 814841 - DNA, 20 bp, Artificial
  CRISPR gRNA sequence
agtatacaattacaaaggat

SEQ ID NO: 814842 - DNA, 20 bp, Artificial
  CRISPR gRNA sequence
gtatacaattacaaaggatg

SEQ ID NO: 814843 - DNA, 20 bp, Artificial
  CRISPR gRNA sequence
caaaggatgaaatgatttga

SEQ ID NO: 814844 - DNA, 20 bp, Artificial
  CRISPR gRNA sequence
gaatgtcaccaatgaagata

SEQ ID NO: 814845 - DNA, 20 bp, Artificial
  CRISPR gRNA sequence
aatgtcaccaatgaagatat

SEQ ID NO: 814846 - DNA, 20 bp, Artificial
  CRISPR gRNA sequence
aactaaggccaggtgcagtg

SEQ ID NO: 814847 - DNA, 20 bp, Artificial
  CRISPR gRNA sequence
actaaggccaggtgcagtgg

SEQ ID NO: 814848 - DNA, 20 bp, Artificial
  CRISPR gRNA sequence
aggccaggtgcagtggctta

SEQ ID NO: 814849 - DNA, 20 bp, Artificial
  CRISPR gRNA sequence
atgcctgtaatcccagcatt

SEQ ID NO: 814850 - DNA, 20 bp, Artificial
  CRISPR gRNA sequence
tgcctgtaatcccagcattt

SEQ ID NO: 814851 - DNA, 20 bp, Artificial
  CRISPR gRNA sequence
taatcccagcattttgggag

SEQ ID NO: 814852 - DNA, 20 bp, Artificial
  CRISPR gRNA sequence
tgggaggctgaggcgagaag

SEQ ID NO: 814853 - DNA, 20 bp, Artificial
  CRISPR gRNA sequence
gggaggctgaggcgagaaga

SEQ ID NO: 814854 - DNA, 20 bp, Artificial
  CRISPR gRNA sequence
ggaggctgaggcgagaagat

SEQ ID NO: 814855 - DNA, 20 bp, Artificial
  CRISPR gRNA sequence
aggcgagaagatggcttgag

SEQ ID NO: 814856 - DNA, 20 bp, Artificial
  CRISPR gRNA sequence
gagtccaggagtttgagact

SEQ ID NO: 814857 - DNA, 20 bp, Artificial
  CRISPR gRNA sequence
agtccaggagtttgagactg

SEQ ID NO: 814858 - DNA, 20 bp, Artificial
  CRISPR gRNA sequence
gagactggcctgggaaacac

SEQ ID NO: 814859 - DNA, 20 bp, Artificial
  CRISPR gRNA sequence
agactggcctgggaaacaca

SEQ ID NO: 814860 - DNA, 20 bp, Artificial
  CRISPR gRNA sequence
gcctgggaaacacaaggaga

SEQ ID NO: 814861 - DNA, 20 bp, Artificial
  CRISPR gRNA sequence
ggaaacacaaggagacccca

SEQ ID NO: 814862 - DNA, 20 bp, Artificial
  CRISPR gRNA sequence
caaaattaaaaaaaaaaaat

SEQ ID NO: 814863 - DNA, 20 bp, Artificial
  CRISPR gRNA sequence
aaaaaaaaaaattagccagg

SEQ ID NO: 814864 - DNA, 20 bp, Artificial
  CRISPR gRNA sequence
gccaggcatggtggcatggc

SEQ ID NO: 814865 - DNA, 20 bp, Artificial
  CRISPR gRNA sequence
tagtcccagttactacagag

SEQ ID NO: 814866 - DNA, 20 bp, Artificial
  CRISPR gRNA sequence
ctacagagtctgaggtggga

SEQ ID NO: 814867 - DNA, 20 bp, Artificial
  CRISPR gRNA sequence
cagagtctgaggtgggagaa

SEQ ID NO: 814868 - DNA, 20 bp, Artificial
  CRISPR gRNA sequence
aggtgggagaatcgcttgag

SEQ ID NO: 814869 - DNA, 20 bp, Artificial
  CRISPR gRNA sequence
gagcctgagagatcgaggct

SEQ ID NO: 814870 - DNA, 20 bp, Artificial
  CRISPR gRNA sequence
agcctgagagatcgaggctg

SEQ ID NO: 814871 - DNA, 20 bp, Artificial
  CRISPR gRNA sequence
agagatcgaggctgcagtga

SEQ ID NO: 814872 - DNA, 20 bp, Artificial
  CRISPR gRNA sequence
cagtgagctatgattatacc

SEQ ID NO: 814873 - DNA, 20 bp, Artificial
  CRISPR gRNA sequence
tgattataccactgtattcc

SEQ ID NO: 814874 - DNA, 20 bp, Artificial
  CRISPR gRNA sequence
taccactgtattccaatctg

SEQ ID NO: 814875 - DNA, 20 bp, Artificial
  CRISPR gRNA sequence
tattccaatctgggcaacag

SEQ ID NO: 814876 - DNA, 20 bp, Artificial
  CRISPR gRNA sequence
caatctgggcaacagagtga

SEQ ID NO: 814877 - DNA, 20 bp, Artificial
  CRISPR gRNA sequence
ggcaacagagtgataccctg

SEQ ID NO: 814878 - DNA, 20 bp, Artificial
  CRISPR gRNA sequence
tctcaaaaaaagaaaaaaat

SEQ ID NO: 814879 - DNA, 20 bp, Artificial
  CRISPR gRNA sequence
aaaaaaagaaaaaaatatgt

SEQ ID NO: 814880 - DNA, 20 bp, Artificial
  CRISPR gRNA sequence
tatataagattataaaataa

SEQ ID NO: 814881 - DNA, 20 bp, Artificial
  CRISPR gRNA sequence
taaaataatatataaatata

SEQ ID NO: 814882 - DNA, 20 bp, Artificial
  CRISPR gRNA sequence
aatatcattagtcattagga

SEQ ID NO: 814883 - DNA, 20 bp, Artificial
  CRISPR gRNA sequence
atatcattagtcattaggaa

SEQ ID NO: 814884 - DNA, 20 bp, Artificial
  CRISPR gRNA sequence
gtcattaggaaaatgcaagt

SEQ ID NO: 814885 - DNA, 20 bp, Artificial
  CRISPR gRNA sequence
ggaaaatgcaagttagaacc

SEQ ID NO: 814886 - DNA, 20 bp, Artificial
  CRISPR gRNA sequence
gaaccacttctacacaccta

SEQ ID NO: 814887 - DNA, 20 bp, Artificial
  CRISPR gRNA sequence
ctacacacctattagaatga

SEQ ID NO: 814888 - DNA, 20 bp, Artificial
  CRISPR gRNA sequence
tacacacctattagaatgac

SEQ ID NO: 814889 - DNA, 20 bp, Artificial
  CRISPR gRNA sequence
cacacctattagaatgactt

SEQ ID NO: 814890 - DNA, 20 bp, Artificial
  CRISPR gRNA sequence
ttagaatgacttaagaaaag

SEQ ID NO: 814891 - DNA, 20 bp, Artificial
  CRISPR gRNA sequence
gaatgacttaagaaaagagc

SEQ ID NO: 814892 - DNA, 20 bp, Artificial
  CRISPR gRNA sequence
aagaaaagagcagggcgtgg

SEQ ID NO: 814893 - DNA, 20 bp, Artificial
  CRISPR gRNA sequence
agaaaagagcagggcgtggt

SEQ ID NO: 814894 - DNA, 20 bp, Artificial
  CRISPR gRNA sequence
atgcctgtaatcccagcatt

SEQ ID NO: 814895 - DNA, 20 bp, Artificial
  CRISPR gRNA sequence
taatcccagcattttgggag

SEQ ID NO: 814896 - DNA, 20 bp, Artificial
  CRISPR gRNA sequence
tgggaggccaaggtgggtgg

SEQ ID NO: 814897 - DNA, 20 bp, Artificial
  CRISPR gRNA sequence
gggaggccaaggtgggtgga

SEQ ID NO: 814898 - DNA, 20 bp, Artificial
  CRISPR gRNA sequence
ggaggccaaggtgggtggat

SEQ ID NO: 814899 - DNA, 20 bp, Artificial
  CRISPR gRNA sequence
aggtcaggagttcaagacca

SEQ ID NO: 814900 - DNA, 20 bp, Artificial
  CRISPR gRNA sequence
aagaccagcctggtcaatat

SEQ ID NO: 814901 - DNA, 20 bp, Artificial
  CRISPR gRNA sequence
gtcaatatggcaaaaccccg

SEQ ID NO: 814902 - DNA, 20 bp, Artificial
  CRISPR gRNA sequence
tattaaaaatacaaaacaaa

SEQ ID NO: 814903 - DNA, 20 bp, Artificial
  CRISPR gRNA sequence
ttaaaaatacaaaacaaaag

SEQ ID NO: 814904 - DNA, 20 bp, Artificial
  CRISPR gRNA sequence
aaaatacaaaacaaaagaag

SEQ ID NO: 814905 - DNA, 20 bp, Artificial
  CRISPR gRNA sequence
taatcccagctacttgggag

SEQ ID NO: 814906 - DNA, 20 bp, Artificial
  CRISPR gRNA sequence
cttgggaggctgaggcagga

SEQ ID NO: 814907 - DNA, 20 bp, Artificial
  CRISPR gRNA sequence
gggaggctgaggcaggagaa

SEQ ID NO: 814908 - DNA, 20 bp, Artificial
  CRISPR gRNA sequence
ggaggctgaggcaggagaat

SEQ ID NO: 814909 - DNA, 20 bp, Artificial
  CRISPR gRNA sequence
aggcaggagaatagcctgaa

SEQ ID NO: 814910 - DNA, 20 bp, Artificial
  CRISPR gRNA sequence
aacccgggaggcggaggttg

SEQ ID NO: 814911 - DNA, 20 bp, Artificial
  CRISPR gRNA sequence
cagtaagccaagatcacggc

SEQ ID NO: 814912 - DNA, 20 bp, Artificial
  CRISPR gRNA sequence
cactttagcctgggtgacag

SEQ ID NO: 814913 - DNA, 20 bp, Artificial
  CRISPR gRNA sequence
tagcctgggtgacagagcga

SEQ ID NO: 814914 - DNA, 20 bp, Artificial
  CRISPR gRNA sequence
agcctgggtgacagagcgaa

SEQ ID NO: 814915 - DNA, 20 bp, Artificial
  CRISPR gRNA sequence
gcctgggtgacagagcgaaa

SEQ ID NO: 814916 - DNA, 20 bp, Artificial
  CRISPR gRNA sequence
ggtgacagagcgaaactctg

SEQ ID NO: 814917 - DNA, 20 bp, Artificial
  CRISPR gRNA sequence
tgtctcaaaaaaaaagaaaa

SEQ ID NO: 814918 - DNA, 20 bp, Artificial
  CRISPR gRNA sequence
tctcaaaaaaaaagaaaaaa

SEQ ID NO: 814919 - DNA, 20 bp, Artificial
  CRISPR gRNA sequence
aaaaaaaaagaaaaaataga

SEQ ID NO: 814920 - DNA, 20 bp, Artificial
  CRISPR gRNA sequence
ggaaggatgaggaacaatta

SEQ ID NO: 814921 - DNA, 20 bp, Artificial
  CRISPR gRNA sequence
gaactctcatatacttgctg

SEQ ID NO: 814922 - DNA, 20 bp, Artificial
  CRISPR gRNA sequence
tcatatacttgctggtggga

SEQ ID NO: 814923 - DNA, 20 bp, Artificial
  CRISPR gRNA sequence
atatacttgctggtgggaat

SEQ ID NO: 814924 - DNA, 20 bp, Artificial
  CRISPR gRNA sequence
gctggtgggaatgaaaaaat

SEQ ID NO: 814925 - DNA, 20 bp, Artificial
  CRISPR gRNA sequence
ctggtgggaatgaaaaaatg

SEQ ID NO: 814926 - DNA, 20 bp, Artificial
  CRISPR gRNA sequence
gtgggaatgaaaaaatggta

SEQ ID NO: 814927 - DNA, 20 bp, Artificial
  CRISPR gRNA sequence
tggaaaggtttggcagtttc

SEQ ID NO: 814928 - DNA, 20 bp, Artificial
  CRISPR gRNA sequence
ggcagtttctcacaataaac

SEQ ID NO: 814929 - DNA, 20 bp, Artificial
  CRISPR gRNA sequence
gcagtttctcacaataaacc

SEQ ID NO: 814930 - DNA, 20 bp, Artificial
  CRISPR gRNA sequence
ctcacaataaaccatacact

SEQ ID NO: 814931 - DNA, 20 bp, Artificial
  CRISPR gRNA sequence
tcacaataaaccatacactt

SEQ ID NO: 814932 - DNA, 20 bp, Artificial
  CRISPR gRNA sequence
acaataaaccatacacttac

SEQ ID NO: 814933 - DNA, 20 bp, Artificial
  CRISPR gRNA sequence
accatgtgacctagcaatcc

SEQ ID NO: 814934 - DNA, 20 bp, Artificial
  CRISPR gRNA sequence
ccatgtgacctagcaatccc

SEQ ID NO: 814935 - DNA, 20 bp, Artificial
  CRISPR gRNA sequence
gcaatcccacttctaggtat

SEQ ID NO: 814936 - DNA, 20 bp, Artificial
  CRISPR gRNA sequence
ctaggtatttatccaagtga

SEQ ID NO: 814937 - DNA, 20 bp, Artificial
  CRISPR gRNA sequence
taggtatttatccaagtgaa

SEQ ID NO: 814938 - DNA, 20 bp, Artificial
  CRISPR gRNA sequence
ggtatttatccaagtgaaat

SEQ ID NO: 814939 - DNA, 20 bp, Artificial
  CRISPR gRNA sequence
atccaagtgaaatgaaaacc

SEQ ID NO: 814940 - DNA, 20 bp, Artificial
  CRISPR gRNA sequence
tccaagtgaaatgaaaacct

SEQ ID NO: 814941 - DNA, 20 bp, Artificial
  CRISPR gRNA sequence
ggtttgcccaaaaaaaccta

SEQ ID NO: 814942 - DNA, 20 bp, Artificial
  CRISPR gRNA sequence
gcccaaaaaaacctatatgc

SEQ ID NO: 814943 - DNA, 20 bp, Artificial
  CRISPR gRNA sequence
cccaaaaaaacctatatgca

SEQ ID NO: 814944 - DNA, 20 bp, Artificial
  CRISPR gRNA sequence
tatgcaaatatttataataa

SEQ ID NO: 814945 - DNA, 20 bp, Artificial
  CRISPR gRNA sequence
ataataactttatttgtaat

SEQ ID NO: 814946 - DNA, 20 bp, Artificial
  CRISPR gRNA sequence
taataactttatttgtaatc

SEQ ID NO: 814947 - DNA, 20 bp, Artificial
  CRISPR gRNA sequence
tatttgtaatcacccaaaat

SEQ ID NO: 814948 - DNA, 20 bp, Artificial
  CRISPR gRNA sequence
atttgtaatcacccaaaatg

SEQ ID NO: 814949 - DNA, 20 bp, Artificial
  CRISPR gRNA sequence
tttgtaatcacccaaaatgg

SEQ ID NO: 814950 - DNA, 20 bp, Artificial
  CRISPR gRNA sequence
gtaatcacccaaaatgggaa

SEQ ID NO: 814951 - DNA, 20 bp, Artificial
  CRISPR gRNA sequence
taatcacccaaaatgggaaa

SEQ ID NO: 814952 - DNA, 20 bp, Artificial
  CRISPR gRNA sequence
gggaatttataaacaaaata

SEQ ID NO: 814953 - DNA, 20 bp, Artificial
  CRISPR gRNA sequence
ataaacaaaatatagtatac

SEQ ID NO: 814954 - DNA, 20 bp, Artificial
  CRISPR gRNA sequence
taaacaaaatatagtataca

SEQ ID NO: 814955 - DNA, 20 bp, Artificial
  CRISPR gRNA sequence
gaatatactcaacagcaaac

SEQ ID NO: 814956 - DNA, 20 bp, Artificial
  CRISPR gRNA sequence
aacagcaaacaggtataaat

SEQ ID NO: 814957 - DNA, 20 bp, Artificial
  CRISPR gRNA sequence
ttgattcacacaacaatatg

SEQ ID NO: 814958 - DNA, 20 bp, Artificial
  CRISPR gRNA sequence
attcacacaacaatatgaat

SEQ ID NO: 814959 - DNA, 20 bp, Artificial
  CRISPR gRNA sequence
acacaacaatatgaatgaat

SEQ ID NO: 814960 - DNA, 20 bp, Artificial
  CRISPR gRNA sequence
caaatgctttatgttaagtg

SEQ ID NO: 814961 - DNA, 20 bp, Artificial
  CRISPR gRNA sequence
aaatgctttatgttaagtga

SEQ ID NO: 814962 - DNA, 20 bp, Artificial
  CRISPR gRNA sequence
tatgttaagtgaaagaagcc

SEQ ID NO: 814963 - DNA, 20 bp, Artificial
  CRISPR gRNA sequence
atgttaagtgaaagaagcca

SEQ ID NO: 814964 - DNA, 20 bp, Artificial
  CRISPR gRNA sequence
tgttaagtgaaagaagccag

SEQ ID NO: 814965 - DNA, 20 bp, Artificial
  CRISPR gRNA sequence
agtgaaagaagccagataca

SEQ ID NO: 814966 - DNA, 20 bp, Artificial
  CRISPR gRNA sequence
atgaatgatcccatttatat

SEQ ID NO: 814967 - DNA, 20 bp, Artificial
  CRISPR gRNA sequence
atatgacattctggaaaagt

SEQ ID NO: 814968 - DNA, 20 bp, Artificial
  CRISPR gRNA sequence
tatgacattctggaaaagtc

SEQ ID NO: 814969 - DNA, 20 bp, Artificial
  CRISPR gRNA sequence
tggaaaagtcattactataa

SEQ ID NO: 814970 - DNA, 20 bp, Artificial
  CRISPR gRNA sequence
gaaaagtcattactataagg

SEQ ID NO: 814971 - DNA, 20 bp, Artificial
  CRISPR gRNA sequence
ctataaggacagaaaataga

SEQ ID NO: 814972 - DNA, 20 bp, Artificial
  CRISPR gRNA sequence
taaggacagaaaatagatca

SEQ ID NO: 814973 - DNA, 20 bp, Artificial
  CRISPR gRNA sequence
gacttaagacttgggtgaag

SEQ ID NO: 814974 - DNA, 20 bp, Artificial
  CRISPR gRNA sequence
aagacttgggtgaagctttt

SEQ ID NO: 814975 - DNA, 20 bp, Artificial
  CRISPR gRNA sequence
agacttgggtgaagcttttt

SEQ ID NO: 814976 - DNA, 20 bp, Artificial
  CRISPR gRNA sequence
gggtgaagctttttgtttgt

SEQ ID NO: 814977 - DNA, 20 bp, Artificial
  CRISPR gRNA sequence
ggtgaagctttttgtttgtt

SEQ ID NO: 814978 - DNA, 20 bp, Artificial
  CRISPR gRNA sequence
tttgtttgtttgtttgtttg

SEQ ID NO: 814979 - DNA, 20 bp, Artificial
  CRISPR gRNA sequence
ttgtttgtttgtttgtttgg

SEQ ID NO: 814980 - DNA, 20 bp, Artificial
  CRISPR gRNA sequence
tgtttgtttgtttgtttggc

SEQ ID NO: 814981 - DNA, 20 bp, Artificial
  CRISPR gRNA sequence
gtttgtttgtttgtttggca

SEQ ID NO: 814982 - DNA, 20 bp, Artificial
  CRISPR gRNA sequence
tttgtttgtttgtttggcaa

SEQ ID NO: 814983 - DNA, 20 bp, Artificial
  CRISPR gRNA sequence
gtttgtttgtttggcaaggg

SEQ ID NO: 814984 - DNA, 20 bp, Artificial
  CRISPR gRNA sequence
tttgtttgtttggcaaggga

SEQ ID NO: 814985 - DNA, 20 bp, Artificial
  CRISPR gRNA sequence
gtttgtttggcaagggatgg

SEQ ID NO: 814986 - DNA, 20 bp, Artificial
  CRISPR gRNA sequence
tttgtttggcaagggatgga

SEQ ID NO: 814987 - DNA, 20 bp, Artificial
  CRISPR gRNA sequence
gtttggcaagggatggaact

SEQ ID NO: 814988 - DNA, 20 bp, Artificial
  CRISPR gRNA sequence
tttggcaagggatggaactg

SEQ ID NO: 814989 - DNA, 20 bp, Artificial
  CRISPR gRNA sequence
ggcaagggatggaactgtcc

SEQ ID NO: 814990 - DNA, 20 bp, Artificial
  CRISPR gRNA sequence
gcaagggatggaactgtcct

SEQ ID NO: 814991 - DNA, 20 bp, Artificial
  CRISPR gRNA sequence
tcctggatgttcactgtggt

SEQ ID NO: 814992 - DNA, 20 bp, Artificial
  CRISPR gRNA sequence
gatgttcactgtggtggtgg

SEQ ID NO: 814993 - DNA, 20 bp, Artificial
  CRISPR gRNA sequence
actgtggtggtggtagttat

SEQ ID NO: 814994 - DNA, 20 bp, Artificial
  CRISPR gRNA sequence
tggtggtggtagttatagga

SEQ ID NO: 814995 - DNA, 20 bp, Artificial
  CRISPR gRNA sequence
taggactatgcatttgttaa

SEQ ID NO: 814996 - DNA, 20 bp, Artificial
  CRISPR gRNA sequence
tgcatttgttaaaattcata

SEQ ID NO: 814997 - DNA, 20 bp, Artificial
  CRISPR gRNA sequence
gttaaaattcataagacttt

SEQ ID NO: 814998 - DNA, 20 bp, Artificial
  CRISPR gRNA sequence
ttaaaattcataagactttt

SEQ ID NO: 814999 - DNA, 20 bp, Artificial
  CRISPR gRNA sequence
aaattcataagactttttta

SEQ ID NO: 815000 - DNA, 20 bp, Artificial
  CRISPR gRNA sequence
ataagacttttttaaaaaaa

SEQ ID NO: 815001 - DNA, 20 bp, Artificial
  CRISPR gRNA sequence
ttttaaaaaaagaataaatg

SEQ ID NO: 815002 - DNA, 20 bp, Artificial
  CRISPR gRNA sequence
tttaaaaaaagaataaatgt

SEQ ID NO: 815003 - DNA, 20 bp, Artificial
  CRISPR gRNA sequence
ttaaaaaaagaataaatgtt

SEQ ID NO: 815004 - DNA, 20 bp, Artificial
  CRISPR gRNA sequence
taaaaaaagaataaatgtta

SEQ ID NO: 815005 - DNA, 20 bp, Artificial
  CRISPR gRNA sequence
aaaaaaagaataaatgttat

SEQ ID NO: 815006 - DNA, 20 bp, Artificial
  CRISPR gRNA sequence
aaaaaagaataaatgttatg

SEQ ID NO: 815007 - DNA, 20 bp, Artificial
  CRISPR gRNA sequence
tggtatataaatttaaacat

SEQ ID NO: 815008 - DNA, 20 bp, Artificial
  CRISPR gRNA sequence
aaacatgcatatgtaagtac

SEQ ID NO: 815009 - DNA, 20 bp, Artificial
  CRISPR gRNA sequence
aacatgcatatgtaagtaca

SEQ ID NO: 815010 - DNA, 20 bp, Artificial
  CRISPR gRNA sequence
taaaaatgatataaaatgtt

SEQ ID NO: 815011 - DNA, 20 bp, Artificial
  CRISPR gRNA sequence
aaaaatgatataaaatgttt

SEQ ID NO: 815012 - DNA, 20 bp, Artificial
  CRISPR gRNA sequence
aaaatgatataaaatgtttt

SEQ ID NO: 815013 - DNA, 20 bp, Artificial
  CRISPR gRNA sequence
taccctaatttttcacttca

SEQ ID NO: 815014 - DNA, 20 bp, Artificial
  CRISPR gRNA sequence
accctaatttttcacttcaa

SEQ ID NO: 815015 - DNA, 20 bp, Artificial
  CRISPR gRNA sequence
ccctaatttttcacttcaaa

SEQ ID NO: 815016 - DNA, 20 bp, Artificial
  CRISPR gRNA sequence
atttttcacttcaaacttta

SEQ ID NO: 815017 - DNA, 20 bp, Artificial
  CRISPR gRNA sequence
ttcacttcaaactttatttt

SEQ ID NO: 815018 - DNA, 20 bp, Artificial
  CRISPR gRNA sequence
tcacttcaaactttatttta

SEQ ID NO: 815019 - DNA, 20 bp, Artificial
  CRISPR gRNA sequence
cacttcaaactttattttat

SEQ ID NO: 815020 - DNA, 20 bp, Artificial
  CRISPR gRNA sequence
acttcaaactttattttata

SEQ ID NO: 815021 - DNA, 20 bp, Artificial
  CRISPR gRNA sequence
caaactttattttatagata

SEQ ID NO: 815022 - DNA, 20 bp, Artificial
  CRISPR gRNA sequence
aaactttattttatagataa

SEQ ID NO: 815023 - DNA, 20 bp, Artificial
  CRISPR gRNA sequence
tattttatagataacacagt

SEQ ID NO: 815024 - DNA, 20 bp, Artificial
  CRISPR gRNA sequence
attttatagataacacagta

SEQ ID NO: 815025 - DNA, 20 bp, Artificial
  CRISPR gRNA sequence
ttttatagataacacagtag

SEQ ID NO: 815026 - DNA, 20 bp, Artificial
  CRISPR gRNA sequence
tatagataacacagtagagc

SEQ ID NO: 815027 - DNA, 20 bp, Artificial
  CRISPR gRNA sequence
atagataacacagtagagca

SEQ ID NO: 815028 - DNA, 20 bp, Artificial
  CRISPR gRNA sequence
tagataacacagtagagcat

SEQ ID NO: 815029 - DNA, 20 bp, Artificial
  CRISPR gRNA sequence
atgattaatgatttgtttga

SEQ ID NO: 815030 - DNA, 20 bp, Artificial
  CRISPR gRNA sequence
atgatttgtttgagttttat

SEQ ID NO: 815031 - DNA, 20 bp, Artificial
  CRISPR gRNA sequence
gtttgagttttattcagagg

SEQ ID NO: 815032 - DNA, 20 bp, Artificial
  CRISPR gRNA sequence
tttgagttttattcagaggc

SEQ ID NO: 815033 - DNA, 20 bp, Artificial
  CRISPR gRNA sequence
gagttttattcagaggcaac

SEQ ID NO: 815034 - DNA, 20 bp, Artificial
  CRISPR gRNA sequence
agttttattcagaggcaact

SEQ ID NO: 815035 - DNA, 20 bp, Artificial
  CRISPR gRNA sequence
tattcagaggcaactttcat

SEQ ID NO: 815036 - DNA, 20 bp, Artificial
  CRISPR gRNA sequence
attcagaggcaactttcatc

SEQ ID NO: 815037 - DNA, 20 bp, Artificial
  CRISPR gRNA sequence
ttcagaggcaactttcatca

SEQ ID NO: 815038 - DNA, 20 bp, Artificial
  CRISPR gRNA sequence
agaggcaactttcatcacag

SEQ ID NO: 815039 - DNA, 20 bp, Artificial
  CRISPR gRNA sequence
tcatcacagtctttaggagg

SEQ ID NO: 815040 - DNA, 20 bp, Artificial
  CRISPR gRNA sequence
catcacagtctttaggaggc

SEQ ID NO: 815041 - DNA, 20 bp, Artificial
  CRISPR gRNA sequence
atcacagtctttaggaggca

SEQ ID NO: 815042 - DNA, 20 bp, Artificial
  CRISPR gRNA sequence
taggaggcacacattttttt

SEQ ID NO: 815043 - DNA, 20 bp, Artificial
  CRISPR gRNA sequence
aggaggcacacatttttttc

SEQ ID NO: 815044 - DNA, 20 bp, Artificial
  CRISPR gRNA sequence
ggaggcacacatttttttca

SEQ ID NO: 815045 - DNA, 20 bp, Artificial
  CRISPR gRNA sequence
ttttcaagcattaatctagc

SEQ ID NO: 815046 - DNA, 20 bp, Artificial
  CRISPR gRNA sequence
tttcaagcattaatctagca

SEQ ID NO: 815047 - DNA, 20 bp, Artificial
  CRISPR gRNA sequence
ttcaagcattaatctagcag

SEQ ID NO: 815048 - DNA, 20 bp, Artificial
  CRISPR gRNA sequence
tcaagcattaatctagcaga

SEQ ID NO: 815049 - DNA, 20 bp, Artificial
  CRISPR gRNA sequence
caagcattaatctagcagaa

SEQ ID NO: 815050 - DNA, 20 bp, Artificial
  CRISPR gRNA sequence
aagcattaatctagcagaag

SEQ ID NO: 815051 - DNA, 20 bp, Artificial
  CRISPR gRNA sequence
atctagcagaagaaaatgga

SEQ ID NO: 815052 - DNA, 20 bp, Artificial
  CRISPR gRNA sequence
gcagaagaaaatggaaataa

SEQ ID NO: 815053 - DNA, 20 bp, Artificial
  CRISPR gRNA sequence
ccaacagggaagtggttaaa

SEQ ID NO: 815054 - DNA, 20 bp, Artificial
  CRISPR gRNA sequence
aataaattacagcatgtcca

SEQ ID NO: 815055 - DNA, 20 bp, Artificial
  CRISPR gRNA sequence
cagcatgtccaataaaatat

SEQ ID NO: 815056 - DNA, 20 bp, Artificial
  CRISPR gRNA sequence
cttaaaaatgcaggatgtct

SEQ ID NO: 815057 - DNA, 20 bp, Artificial
  CRISPR gRNA sequence
aaaaatgcaggatgtctata

SEQ ID NO: 815058 - DNA, 20 bp, Artificial
  CRISPR gRNA sequence
aaaatgcaggatgtctatat

SEQ ID NO: 815059 - DNA, 20 bp, Artificial
  CRISPR gRNA sequence
tatttgctgatttggaaact

SEQ ID NO: 815060 - DNA, 20 bp, Artificial
  CRISPR gRNA sequence
gctgatttggaaactataaa

SEQ ID NO: 815061 - DNA, 20 bp, Artificial
  CRISPR gRNA sequence
ctgatttggaaactataaag

SEQ ID NO: 815062 - DNA, 20 bp, Artificial
  CRISPR gRNA sequence
atttggaaactataaagaac

SEQ ID NO: 815063 - DNA, 20 bp, Artificial
  CRISPR gRNA sequence
ggaaactataaagaacatac

SEQ ID NO: 815064 - DNA, 20 bp, Artificial
  CRISPR gRNA sequence
gaaactataaagaacataca

SEQ ID NO: 815065 - DNA, 20 bp, Artificial
  CRISPR gRNA sequence
taaagaacatacatttattg

SEQ ID NO: 815066 - DNA, 20 bp, Artificial
  CRISPR gRNA sequence
attgaatgcttactaaaact

SEQ ID NO: 815067 - DNA, 20 bp, Artificial
  CRISPR gRNA sequence
ttgaatgcttactaaaactt

SEQ ID NO: 815068 - DNA, 20 bp, Artificial
  CRISPR gRNA sequence
aatgcttactaaaacttctt

SEQ ID NO: 815069 - DNA, 20 bp, Artificial
  CRISPR gRNA sequence
actaaaacttcttttagtcc

SEQ ID NO: 815070 - DNA, 20 bp, Artificial
  CRISPR gRNA sequence
ctaaaacttcttttagtcct

SEQ ID NO: 815071 - DNA, 20 bp, Artificial
  CRISPR gRNA sequence
aaacttcttttagtcctctt

SEQ ID NO: 815072 - DNA, 20 bp, Artificial
  CRISPR gRNA sequence
cttttagtcctcttcagcaa

SEQ ID NO: 815073 - DNA, 20 bp, Artificial
  CRISPR gRNA sequence
ttttagtcctcttcagcaat

SEQ ID NO: 815074 - DNA, 20 bp, Artificial
  CRISPR gRNA sequence
ttagtcctcttcagcaattt

SEQ ID NO: 815075 - DNA, 20 bp, Artificial
  CRISPR gRNA sequence
tagtcctcttcagcaatttc

SEQ ID NO: 815076 - DNA, 20 bp, Artificial
  CRISPR gRNA sequence
agtcctcttcagcaatttct

SEQ ID NO: 815077 - DNA, 20 bp, Artificial
  CRISPR gRNA sequence
gtcctcttcagcaatttctt

SEQ ID NO: 815078 - DNA, 20 bp, Artificial
  CRISPR gRNA sequence
ttcagcaatttctttcatga

SEQ ID NO: 815079 - DNA, 20 bp, Artificial
  CRISPR gRNA sequence
cagcaatttctttcatgaaa

SEQ ID NO: 815080 - DNA, 20 bp, Artificial
  CRISPR gRNA sequence
agcaatttctttcatgaaaa

SEQ ID NO: 815081 - DNA, 20 bp, Artificial
  CRISPR gRNA sequence
ctttcatgaaaaaataaagg

SEQ ID NO: 815082 - DNA, 20 bp, Artificial
  CRISPR gRNA sequence
tttcatgaaaaaataaaggg

SEQ ID NO: 815083 - DNA, 20 bp, Artificial
  CRISPR gRNA sequence
tcatgaaaaaataaagggca

SEQ ID NO: 815084 - DNA, 20 bp, Artificial
  CRISPR gRNA sequence
catgaaaaaataaagggcag

SEQ ID NO: 815085 - DNA, 20 bp, Artificial
  CRISPR gRNA sequence
atgaaaaaataaagggcagg

SEQ ID NO: 815086 - DNA, 20 bp, Artificial
  CRISPR gRNA sequence
agagtgatggctcacacctg

SEQ ID NO: 815087 - DNA, 20 bp, Artificial
  CRISPR gRNA sequence
acacctgtgatctcagtgct

SEQ ID NO: 815088 - DNA, 20 bp, Artificial
  CRISPR gRNA sequence
tgatctcagtgctttgggag

SEQ ID NO: 815089 - DNA, 20 bp, Artificial
  CRISPR gRNA sequence
agtgctttgggaggctgggg

SEQ ID NO: 815090 - DNA, 20 bp, Artificial
  CRISPR gRNA sequence
tgggaggctggggcaggagg

SEQ ID NO: 815091 - DNA, 20 bp, Artificial
  CRISPR gRNA sequence
gggaggctggggcaggagga

SEQ ID NO: 815092 - DNA, 20 bp, Artificial
  CRISPR gRNA sequence
ggaggctggggcaggaggat

SEQ ID NO: 815093 - DNA, 20 bp, Artificial
  CRISPR gRNA sequence
gggcaggaggattgcttgag

SEQ ID NO: 815094 - DNA, 20 bp, Artificial
  CRISPR gRNA sequence
cttgagacgaggcgtttgag

SEQ ID NO: 815095 - DNA, 20 bp, Artificial
  CRISPR gRNA sequence
gagacgaggcgtttgaggcc

SEQ ID NO: 815096 - DNA, 20 bp, Artificial
  CRISPR gRNA sequence
agacgaggcgtttgaggcca

SEQ ID NO: 815097 - DNA, 20 bp, Artificial
  CRISPR gRNA sequence
gaggccagcctgtgtaacat

SEQ ID NO: 815098 - DNA, 20 bp, Artificial
  CRISPR gRNA sequence
aggccagcctgtgtaacata

SEQ ID NO: 815099 - DNA, 20 bp, Artificial
  CRISPR gRNA sequence
tgtaacatagcaagacccca

SEQ ID NO: 815100 - DNA, 20 bp, Artificial
  CRISPR gRNA sequence
aaaatgtttaaaaaattagc

SEQ ID NO: 815101 - DNA, 20 bp, Artificial
  CRISPR gRNA sequence
aaaaaattagccagaccggg

SEQ ID NO: 815102 - DNA, 20 bp, Artificial
  CRISPR gRNA sequence
aaaaattagccagaccgggt

SEQ ID NO: 815103 - DNA, 20 bp, Artificial
  CRISPR gRNA sequence
gccagaccgggtggtacatg

SEQ ID NO: 815104 - DNA, 20 bp, Artificial
  CRISPR gRNA sequence
tagtcctagctactcaggag

SEQ ID NO: 815105 - DNA, 20 bp, Artificial
  CRISPR gRNA sequence
gctactcaggagattgaggc

SEQ ID NO: 815106 - DNA, 20 bp, Artificial
  CRISPR gRNA sequence
ctcaggagattgaggcagga

SEQ ID NO: 815107 - DNA, 20 bp, Artificial
  CRISPR gRNA sequence
aggagattgaggcaggagac

SEQ ID NO: 815108 - DNA, 20 bp, Artificial
  CRISPR gRNA sequence
aggcaggagactcacttgag

SEQ ID NO: 815109 - DNA, 20 bp, Artificial
  CRISPR gRNA sequence
acttgagcctgggagttgga

SEQ ID NO: 815110 - DNA, 20 bp, Artificial
  CRISPR gRNA sequence
gagcctgggagttggaggct

SEQ ID NO: 815111 - DNA, 20 bp, Artificial
  CRISPR gRNA sequence
agcctgggagttggaggctg

SEQ ID NO: 815112 - DNA, 20 bp, Artificial
  CRISPR gRNA sequence
ggagttggaggctgcagtga

SEQ ID NO: 815113 - DNA, 20 bp, Artificial
  CRISPR gRNA sequence
gaggctgcagtgagctgtgg

SEQ ID NO: 815114 - DNA, 20 bp, Artificial
  CRISPR gRNA sequence
cagtgagctgtggttgggcc

SEQ ID NO: 815115 - DNA, 20 bp, Artificial
  CRISPR gRNA sequence
tggttgggccactgcactcc

SEQ ID NO: 815116 - DNA, 20 bp, Artificial
  CRISPR gRNA sequence
ggccactgcactccagcatg

SEQ ID NO: 815117 - DNA, 20 bp, Artificial
  CRISPR gRNA sequence
cactccagcatggatgacag

SEQ ID NO: 815118 - DNA, 20 bp, Artificial
  CRISPR gRNA sequence
cagcatggatgacagaggaa

SEQ ID NO: 815119 - DNA, 20 bp, Artificial
  CRISPR gRNA sequence
tctctaaaaagttttgtttt

SEQ ID NO: 815120 - DNA, 20 bp, Artificial
  CRISPR gRNA sequence
taaaaagttttgttttaatt

SEQ ID NO: 815121 - DNA, 20 bp, Artificial
  CRISPR gRNA sequence
aaaagttttgttttaattta

SEQ ID NO: 815122 - DNA, 20 bp, Artificial
  CRISPR gRNA sequence
tgttttaatttaaaaaaggt

SEQ ID NO: 815123 - DNA, 20 bp, Artificial
  CRISPR gRNA sequence
gttttaatttaaaaaaggta

SEQ ID NO: 815124 - DNA, 20 bp, Artificial
  CRISPR gRNA sequence
ttttaatttaaaaaaggtaa

SEQ ID NO: 815125 - DNA, 20 bp, Artificial
  CRISPR gRNA sequence
taatttaaaaaaggtaaaaa

SEQ ID NO: 815126 - DNA, 20 bp, Artificial
  CRISPR gRNA sequence
aatttaaaaaaggtaaaaat

SEQ ID NO: 815127 - DNA, 20 bp, Artificial
  CRISPR gRNA sequence
atttaaaaaaggtaaaaata

SEQ ID NO: 815128 - DNA, 20 bp, Artificial
  CRISPR gRNA sequence
aaaaaaggtaaaaataaagg

SEQ ID NO: 815129 - DNA, 20 bp, Artificial
  CRISPR gRNA sequence
aaaaaggtaaaaataaaggg

SEQ ID NO: 815130 - DNA, 20 bp, Artificial
  CRISPR gRNA sequence
tgaagagtatttgcaaagga

SEQ ID NO: 815131 - DNA, 20 bp, Artificial
  CRISPR gRNA sequence
gcaaaggaggttttattggg

SEQ ID NO: 815132 - DNA, 20 bp, Artificial
  CRISPR gRNA sequence
caaaggaggttttattgggc

SEQ ID NO: 815133 - DNA, 20 bp, Artificial
  CRISPR gRNA sequence
tattgggctagggtatgtga

SEQ ID NO: 815134 - DNA, 20 bp, Artificial
  CRISPR gRNA sequence
attgggctagggtatgtgaa

SEQ ID NO: 815135 - DNA, 20 bp, Artificial
  CRISPR gRNA sequence
ttgggctagggtatgtgaag

SEQ ID NO: 815136 - DNA, 20 bp, Artificial
  CRISPR gRNA sequence
ggctagggtatgtgaagcat

SEQ ID NO: 815137 - DNA, 20 bp, Artificial
  CRISPR gRNA sequence
gggtatgtgaagcatttctg

SEQ ID NO: 815138 - DNA, 20 bp, Artificial
  CRISPR gRNA sequence
ctggggagctgacaaagttc

SEQ ID NO: 815139 - DNA, 20 bp, Artificial
  CRISPR gRNA sequence
tggggagctgacaaagttct

SEQ ID NO: 815140 - DNA, 20 bp, Artificial
  CRISPR gRNA sequence
gggagctgacaaagttcttc

SEQ ID NO: 815141 - DNA, 20 bp, Artificial
  CRISPR gRNA sequence
acaaagttcttcttaacctg

SEQ ID NO: 815142 - DNA, 20 bp, Artificial
  CRISPR gRNA sequence
ttcttaacctgggtggtggt

SEQ ID NO: 815143 - DNA, 20 bp, Artificial
  CRISPR gRNA sequence
cttaacctgggtggtggtta

SEQ ID NO: 815144 - DNA, 20 bp, Artificial
  CRISPR gRNA sequence
ttaacctgggtggtggttac

SEQ ID NO: 815145 - DNA, 20 bp, Artificial
  CRISPR gRNA sequence
aacctgggtggtggttacaa

SEQ ID NO: 815146 - DNA, 20 bp, Artificial
  CRISPR gRNA sequence
acctgggtggtggttacaaa

SEQ ID NO: 815147 - DNA, 20 bp, Artificial
  CRISPR gRNA sequence
ggtggtggttacaaaagtaa

SEQ ID NO: 815148 - DNA, 20 bp, Artificial
  CRISPR gRNA sequence
caaaagtaatcaccttatag

SEQ ID NO: 815149 - DNA, 20 bp, Artificial
  CRISPR gRNA sequence
atagtaatgttaagctttat

SEQ ID NO: 815150 - DNA, 20 bp, Artificial
  CRISPR gRNA sequence
tagtaatgttaagctttata

SEQ ID NO: 815151 - DNA, 20 bp, Artificial
  CRISPR gRNA sequence
agctttatagttgtttcatg

SEQ ID NO: 815152 - DNA, 20 bp, Artificial
  CRISPR gRNA sequence
tatagttgtttcatgtggtt

SEQ ID NO: 815153 - DNA, 20 bp, Artificial
  CRISPR gRNA sequence
atagttgtttcatgtggttt

SEQ ID NO: 815154 - DNA, 20 bp, Artificial
  CRISPR gRNA sequence
tagttgtttcatgtggtttt

SEQ ID NO: 815155 - DNA, 20 bp, Artificial
  CRISPR gRNA sequence
tttcatgtggttttctctgt

SEQ ID NO: 815156 - DNA, 20 bp, Artificial
  CRISPR gRNA sequence
catgtggttttctctgtgat

SEQ ID NO: 815157 - DNA, 20 bp, Artificial
  CRISPR gRNA sequence
atgtggttttctctgtgata

SEQ ID NO: 815158 - DNA, 20 bp, Artificial
  CRISPR gRNA sequence
tctctgtgatatattttaca

SEQ ID NO: 815159 - DNA, 20 bp, Artificial
  CRISPR gRNA sequence
ctctgtgatatattttacaa

SEQ ID NO: 815160 - DNA, 20 bp, Artificial
  CRISPR gRNA sequence
tctgtgatatattttacaac

SEQ ID NO: 815161 - DNA, 20 bp, Artificial
  CRISPR gRNA sequence
tgtgatatattttacaacag

SEQ ID NO: 815162 - DNA, 20 bp, Artificial
  CRISPR gRNA sequence
tgatatattttacaacagaa

SEQ ID NO: 815163 - DNA, 20 bp, Artificial
  CRISPR gRNA sequence
tacaacagaaagctttaaat

SEQ ID NO: 815164 - DNA, 20 bp, Artificial
  CRISPR gRNA sequence
acaacagaaagctttaaata

SEQ ID NO: 815165 - DNA, 20 bp, Artificial
  CRISPR gRNA sequence
caacagaaagctttaaataa

SEQ ID NO: 815166 - DNA, 20 bp, Artificial
  CRISPR gRNA sequence
taaataaattttcaaaatat

SEQ ID NO: 815167 - DNA, 20 bp, Artificial
  CRISPR gRNA sequence
aaataaattttcaaaatata

SEQ ID NO: 815168 - DNA, 20 bp, Artificial
  CRISPR gRNA sequence
aataaattttcaaaatatat

SEQ ID NO: 815169 - DNA, 20 bp, Artificial
  CRISPR gRNA sequence
tcaaaatatatttaattaag

SEQ ID NO: 815170 - DNA, 20 bp, Artificial
  CRISPR gRNA sequence
caaaatatatttaattaagt

SEQ ID NO: 815171 - DNA, 20 bp, Artificial
  CRISPR gRNA sequence
aaaatatatttaattaagta

SEQ ID NO: 815172 - DNA, 20 bp, Artificial
  CRISPR gRNA sequence
aattaagtaaaatgaacatc

SEQ ID NO: 815173 - DNA, 20 bp, Artificial
  CRISPR gRNA sequence
attaagtaaaatgaacatct

SEQ ID NO: 815174 - DNA, 20 bp, Artificial
  CRISPR gRNA sequence
agtaaaatgaacatctgtga

SEQ ID NO: 815175 - DNA, 20 bp, Artificial
  CRISPR gRNA sequence
tgaacctaccacctacccta

SEQ ID NO: 815176 - DNA, 20 bp, Artificial
  CRISPR gRNA sequence
ccacctaccctaagaactag

SEQ ID NO: 815177 - DNA, 20 bp, Artificial
  CRISPR gRNA sequence
ccctaagaactagcacatta

SEQ ID NO: 815178 - DNA, 20 bp, Artificial
  CRISPR gRNA sequence
agaactagcacattactaat

SEQ ID NO: 815179 - DNA, 20 bp, Artificial
  CRISPR gRNA sequence
gcacattactaatgatgtat

SEQ ID NO: 815180 - DNA, 20 bp, Artificial
  CRISPR gRNA sequence
ctaatgatgtatgtctgcct

SEQ ID NO: 815181 - DNA, 20 bp, Artificial
  CRISPR gRNA sequence
atgatgtatgtctgcctgca

SEQ ID NO: 815182 - DNA, 20 bp, Artificial
  CRISPR gRNA sequence
cctgcaccagaggtaactgg

SEQ ID NO: 815183 - DNA, 20 bp, Artificial
  CRISPR gRNA sequence
caccagaggtaactggcgtc

SEQ ID NO: 815184 - DNA, 20 bp, Artificial
  CRISPR gRNA sequence
gcgtcctgaatatcgggctt

SEQ ID NO: 815185 - DNA, 20 bp, Artificial
  CRISPR gRNA sequence
aatatcgggcttatcagtct

SEQ ID NO: 815186 - DNA, 20 bp, Artificial
  CRISPR gRNA sequence
atcagtctcttccttacttt

SEQ ID NO: 815187 - DNA, 20 bp, Artificial
  CRISPR gRNA sequence
tcagtctcttccttactttt

SEQ ID NO: 815188 - DNA, 20 bp, Artificial
  CRISPR gRNA sequence
ttccttactttttttttttt

SEQ ID NO: 815189 - DNA, 20 bp, Artificial
  CRISPR gRNA sequence
ccttactttttttttttttt

SEQ ID NO: 815190 - DNA, 20 bp, Artificial
  CRISPR gRNA sequence
cttacttttttttttttttt

SEQ ID NO: 815191 - DNA, 20 bp, Artificial
  CRISPR gRNA sequence
actttttttttttttttttg

SEQ ID NO: 815192 - DNA, 20 bp, Artificial
  CRISPR gRNA sequence
ctttttttttttttttttga

SEQ ID NO: 815193 - DNA, 20 bp, Artificial
  CRISPR gRNA sequence
tttttttttttttttgagac

SEQ ID NO: 815194 - DNA, 20 bp, Artificial
  CRISPR gRNA sequence
ttttttttttttttgagacg

SEQ ID NO: 815195 - DNA, 20 bp, Artificial
  CRISPR gRNA sequence
tttttttttttttgagacgg

SEQ ID NO: 815196 - DNA, 20 bp, Artificial
  CRISPR gRNA sequence
ttttttttttttgagacgga

SEQ ID NO: 815197 - DNA, 20 bp, Artificial
  CRISPR gRNA sequence
tttttttttttgagacggag

SEQ ID NO: 815198 - DNA, 20 bp, Artificial
  CRISPR gRNA sequence
ttttttttttgagacggagt

SEQ ID NO: 815199 - DNA, 20 bp, Artificial
  CRISPR gRNA sequence
tttttttttgagacggagtc

SEQ ID NO: 815200 - DNA, 20 bp, Artificial
  CRISPR gRNA sequence
ttttttttgagacggagtct

SEQ ID NO: 815201 - DNA, 20 bp, Artificial
  CRISPR gRNA sequence
tttttttgagacggagtctc

SEQ ID NO: 815202 - DNA, 20 bp, Artificial
  CRISPR gRNA sequence
ttttttgagacggagtctca

SEQ ID NO: 815203 - DNA, 20 bp, Artificial
  CRISPR gRNA sequence
tttttgagacggagtctcac

SEQ ID NO: 815204 - DNA, 20 bp, Artificial
  CRISPR gRNA sequence
ttttgagacggagtctcact

SEQ ID NO: 815205 - DNA, 20 bp, Artificial
  CRISPR gRNA sequence
tttgagacggagtctcactc

SEQ ID NO: 815206 - DNA, 20 bp, Artificial
  CRISPR gRNA sequence
ttgagacggagtctcactct

SEQ ID NO: 815207 - DNA, 20 bp, Artificial
  CRISPR gRNA sequence
tgagacggagtctcactctg

SEQ ID NO: 815208 - DNA, 20 bp, Artificial
  CRISPR gRNA sequence
gagacggagtctcactctgt

SEQ ID NO: 815209 - DNA, 20 bp, Artificial
  CRISPR gRNA sequence
agacggagtctcactctgtc

SEQ ID NO: 815210 - DNA, 20 bp, Artificial
  CRISPR gRNA sequence
actctgtcgcccaggctaga

SEQ ID NO: 815211 - DNA, 20 bp, Artificial
  CRISPR gRNA sequence
tgtcgcccaggctagagtgc

SEQ ID NO: 815212 - DNA, 20 bp, Artificial
  CRISPR gRNA sequence
tcgcccaggctagagtgcag

SEQ ID NO: 815213 - DNA, 20 bp, Artificial
  CRISPR gRNA sequence
gagtgcagtggcgtgatctt

SEQ ID NO: 815214 - DNA, 20 bp, Artificial
  CRISPR gRNA sequence
ggctcaccgccacctccgac

SEQ ID NO: 815215 - DNA, 20 bp, Artificial
  CRISPR gRNA sequence
gctcaccgccacctccgact

SEQ ID NO: 815216 - DNA, 20 bp, Artificial
  CRISPR gRNA sequence
accgccacctccgactccct

SEQ ID NO: 815217 - DNA, 20 bp, Artificial
  CRISPR gRNA sequence
cgactccctggttcaagcga

SEQ ID NO: 815218 - DNA, 20 bp, Artificial
  CRISPR gRNA sequence
cctggttcaagcgattctcc

SEQ ID NO: 815219 - DNA, 20 bp, Artificial
  CRISPR gRNA sequence
gttcaagcgattctcctgcc

SEQ ID NO: 815220 - DNA, 20 bp, Artificial
  CRISPR gRNA sequence
aagcgattctcctgcctcag

SEQ ID NO: 815221 - DNA, 20 bp, Artificial
  CRISPR gRNA sequence
tcctgcctcagactcccgag

SEQ ID NO: 815222 - DNA, 20 bp, Artificial
  CRISPR gRNA sequence
ctgcctcagactcccgagta

SEQ ID NO: 815223 - DNA, 20 bp, Artificial
  CRISPR gRNA sequence
cctcagactcccgagtagct

SEQ ID NO: 815224 - DNA, 20 bp, Artificial
  CRISPR gRNA sequence
agactcccgagtagctggga

SEQ ID NO: 815225 - DNA, 20 bp, Artificial
  CRISPR gRNA sequence
ccgagtagctgggattacag

SEQ ID NO: 815226 - DNA, 20 bp, Artificial
  CRISPR gRNA sequence
ggattacaggcttgtgccac

SEQ ID NO: 815227 - DNA, 20 bp, Artificial
  CRISPR gRNA sequence
caggcttgtgccaccatgcc

SEQ ID NO: 815228 - DNA, 20 bp, Artificial
  CRISPR gRNA sequence
gtgccaccatgcccagctaa

SEQ ID NO: 815229 - DNA, 20 bp, Artificial
  CRISPR gRNA sequence
tgccaccatgcccagctaat

SEQ ID NO: 815230 - DNA, 20 bp, Artificial
  CRISPR gRNA sequence
atttttgtattttttgtaga

SEQ ID NO: 815231 - DNA, 20 bp, Artificial
  CRISPR gRNA sequence
ttgtattttttgtagagacg

SEQ ID NO: 815232 - DNA, 20 bp, Artificial
  CRISPR gRNA sequence
tgtattttttgtagagacga

SEQ ID NO: 815233 - DNA, 20 bp, Artificial
  CRISPR gRNA sequence
gtattttttgtagagacgag

SEQ ID NO: 815234 - DNA, 20 bp, Artificial
  CRISPR gRNA sequence
tattttttgtagagacgagg

SEQ ID NO: 815235 - DNA, 20 bp, Artificial
  CRISPR gRNA sequence
tttgtagagacgaggtttca

SEQ ID NO: 815236 - DNA, 20 bp, Artificial
  CRISPR gRNA sequence
ttgtagagacgaggtttcac

SEQ ID NO: 815237 - DNA, 20 bp, Artificial
  CRISPR gRNA sequence
tgtagagacgaggtttcacc

SEQ ID NO: 815238 - DNA, 20 bp, Artificial
  CRISPR gRNA sequence
gtagagacgaggtttcacca

SEQ ID NO: 815239 - DNA, 20 bp, Artificial
  CRISPR gRNA sequence
tagagacgaggtttcaccat

SEQ ID NO: 815240 - DNA, 20 bp, Artificial
  CRISPR gRNA sequence
caccatgcgggccaggctgg

SEQ ID NO: 815241 - DNA, 20 bp, Artificial
  CRISPR gRNA sequence
accatgcgggccaggctggt

SEQ ID NO: 815242 - DNA, 20 bp, Artificial
  CRISPR gRNA sequence
gtctcggtctcctgacctcg

SEQ ID NO: 815243 - DNA, 20 bp, Artificial
  CRISPR gRNA sequence
ggtctcctgacctcgtgatc

SEQ ID NO: 815244 - DNA, 20 bp, Artificial
  CRISPR gRNA sequence
ctgacctcgtgatctgccca

SEQ ID NO: 815245 - DNA, 20 bp, Artificial
  CRISPR gRNA sequence
acctcgtgatctgcccacct

SEQ ID NO: 815246 - DNA, 20 bp, Artificial
  CRISPR gRNA sequence
gtgatctgcccaccttggcc

SEQ ID NO: 815247 - DNA, 20 bp, Artificial
  CRISPR gRNA sequence
cccaccttggcctcccaaag

SEQ ID NO: 815248 - DNA, 20 bp, Artificial
  CRISPR gRNA sequence
ggcctcccaaagtgctggga

SEQ ID NO: 815249 - DNA, 20 bp, Artificial
  CRISPR gRNA sequence
gcctcccaaagtgctgggat

SEQ ID NO: 815250 - DNA, 20 bp, Artificial
  CRISPR gRNA sequence
ccaaagtgctgggattacag

SEQ ID NO: 815251 - DNA, 20 bp, Artificial
  CRISPR gRNA sequence
ggattacaggcgtgagccac

SEQ ID NO: 815252 - DNA, 20 bp, Artificial
  CRISPR gRNA sequence
caggcgtgagccaccatgcc

SEQ ID NO: 815253 - DNA, 20 bp, Artificial
  CRISPR gRNA sequence
ttctttactttttaagcttt

SEQ ID NO: 815254 - DNA, 20 bp, Artificial
  CRISPR gRNA sequence
ctttactttttaagctttat

SEQ ID NO: 815255 - DNA, 20 bp, Artificial
  CRISPR gRNA sequence
tttactttttaagctttatc

SEQ ID NO: 815256 - DNA, 20 bp, Artificial
  CRISPR gRNA sequence
tactttttaagctttatctt

SEQ ID NO: 815257 - DNA, 20 bp, Artificial
  CRISPR gRNA sequence
actttttaagctttatcttc

SEQ ID NO: 815258 - DNA, 20 bp, Artificial
  CRISPR gRNA sequence
ctttttaagctttatcttct

SEQ ID NO: 815259 - DNA, 20 bp, Artificial
  CRISPR gRNA sequence
tttaagctttatcttctata

SEQ ID NO: 815260 - DNA, 20 bp, Artificial
  CRISPR gRNA sequence
ttaagctttatcttctatat

SEQ ID NO: 815261 - DNA, 20 bp, Artificial
  CRISPR gRNA sequence
taagctttatcttctatata

SEQ ID NO: 815262 - DNA, 20 bp, Artificial
  CRISPR gRNA sequence
aagctttatcttctatatat

SEQ ID NO: 815263 - DNA, 20 bp, Artificial
  CRISPR gRNA sequence
agctttatcttctatatata

SEQ ID NO: 815264 - DNA, 20 bp, Artificial
  CRISPR gRNA sequence
tatcttctatatataaggta

SEQ ID NO: 815265 - DNA, 20 bp, Artificial
  CRISPR gRNA sequence
atcttctatatataaggtat

SEQ ID NO: 815266 - DNA, 20 bp, Artificial
  CRISPR gRNA sequence
tcttctatatataaggtatg

SEQ ID NO: 815267 - DNA, 20 bp, Artificial
  CRISPR gRNA sequence
ctatatataaggtatgctta

SEQ ID NO: 815268 - DNA, 20 bp, Artificial
  CRISPR gRNA sequence
tatatataaggtatgcttaa

SEQ ID NO: 815269 - DNA, 20 bp, Artificial
  CRISPR gRNA sequence
tatataaggtatgcttaagc

SEQ ID NO: 815270 - DNA, 20 bp, Artificial
  CRISPR gRNA sequence
aagcaatatatttatttatg

SEQ ID NO: 815271 - DNA, 20 bp, Artificial
  CRISPR gRNA sequence
agcaatatatttatttatga

SEQ ID NO: 815272 - DNA, 20 bp, Artificial
  CRISPR gRNA sequence
atttatgaaaaggacattgt

SEQ ID NO: 815273 - DNA, 20 bp, Artificial
  CRISPR gRNA sequence
tttatgaaaaggacattgtg

SEQ ID NO: 815274 - DNA, 20 bp, Artificial
  CRISPR gRNA sequence
atgaaaaggacattgtgcta

SEQ ID NO: 815275 - DNA, 20 bp, Artificial
  CRISPR gRNA sequence
tgaaaaggacattgtgctat

SEQ ID NO: 815276 - DNA, 20 bp, Artificial
  CRISPR gRNA sequence
tgctatgtgttatcttctgg

SEQ ID NO: 815277 - DNA, 20 bp, Artificial
  CRISPR gRNA sequence
tgtgttatcttctggcctta

SEQ ID NO: 815278 - DNA, 20 bp, Artificial
  CRISPR gRNA sequence
tcttctggccttaattttta

SEQ ID NO: 815279 - DNA, 20 bp, Artificial
  CRISPR gRNA sequence
ctggccttaatttttattta

SEQ ID NO: 815280 - DNA, 20 bp, Artificial
  CRISPR gRNA sequence
tggccttaatttttatttat

SEQ ID NO: 815281 - DNA, 20 bp, Artificial
  CRISPR gRNA sequence
gccttaatttttatttattt

SEQ ID NO: 815282 - DNA, 20 bp, Artificial
  CRISPR gRNA sequence
aatttttatttatttatttt

SEQ ID NO: 815283 - DNA, 20 bp, Artificial
  CRISPR gRNA sequence
atttttatttatttattttt

SEQ ID NO: 815284 - DNA, 20 bp, Artificial
  CRISPR gRNA sequence
ttatttatttattttttact

SEQ ID NO: 815285 - DNA, 20 bp, Artificial
  CRISPR gRNA sequence
tatttatttattttttactc

SEQ ID NO: 815286 - DNA, 20 bp, Artificial
  CRISPR gRNA sequence
atttatttattttttactca

SEQ ID NO: 815287 - DNA, 20 bp, Artificial
  CRISPR gRNA sequence
tttatttattttttactcaa

SEQ ID NO: 815288 - DNA, 20 bp, Artificial
  CRISPR gRNA sequence
atttattttttactcaatat

SEQ ID NO: 815289 - DNA, 20 bp, Artificial
  CRISPR gRNA sequence
tttattttttactcaatatt

SEQ ID NO: 815290 - DNA, 20 bp, Artificial
  CRISPR gRNA sequence
attttttactcaatattatg

SEQ ID NO: 815291 - DNA, 20 bp, Artificial
  CRISPR gRNA sequence
ttttttactcaatattatgc

SEQ ID NO: 815292 - DNA, 20 bp, Artificial
  CRISPR gRNA sequence
tttactcaatattatgctct

SEQ ID NO: 815293 - DNA, 20 bp, Artificial
  CRISPR gRNA sequence
ttactcaatattatgctcta

SEQ ID NO: 815294 - DNA, 20 bp, Artificial
  CRISPR gRNA sequence
tactcaatattatgctctaa

SEQ ID NO: 815295 - DNA, 20 bp, Artificial
  CRISPR gRNA sequence
actcaatattatgctctaag

SEQ ID NO: 815296 - DNA, 20 bp, Artificial
  CRISPR gRNA sequence
ctcaatattatgctctaaga

SEQ ID NO: 815297 - DNA, 20 bp, Artificial
  CRISPR gRNA sequence
aatattatgctctaagattc

SEQ ID NO: 815298 - DNA, 20 bp, Artificial
  CRISPR gRNA sequence
tgctctaagattcatagatg

SEQ ID NO: 815299 - DNA, 20 bp, Artificial
  CRISPR gRNA sequence
taagattcatagatgtagtt

SEQ ID NO: 815300 - DNA, 20 bp, Artificial
  CRISPR gRNA sequence
agattcatagatgtagttac

SEQ ID NO: 815301 - DNA, 20 bp, Artificial
  CRISPR gRNA sequence
atagatgtagttacatgttt

SEQ ID NO: 815302 - DNA, 20 bp, Artificial
  CRISPR gRNA sequence
catgtttttgtaatttatct

SEQ ID NO: 815303 - DNA, 20 bp, Artificial
  CRISPR gRNA sequence
ttgtaatttatctacatgct

SEQ ID NO: 815304 - DNA, 20 bp, Artificial
  CRISPR gRNA sequence
tgtaatttatctacatgcta

SEQ ID NO: 815305 - DNA, 20 bp, Artificial
  CRISPR gRNA sequence
gtaatttatctacatgctat

SEQ ID NO: 815306 - DNA, 20 bp, Artificial
  CRISPR gRNA sequence
taatttatctacatgctata

SEQ ID NO: 815307 - DNA, 20 bp, Artificial
  CRISPR gRNA sequence
atctacatgctatataataa

SEQ ID NO: 815308 - DNA, 20 bp, Artificial
  CRISPR gRNA sequence
tctacatgctatataataat

SEQ ID NO: 815309 - DNA, 20 bp, Artificial
  CRISPR gRNA sequence
catgctatataataatagat

SEQ ID NO: 815310 - DNA, 20 bp, Artificial
  CRISPR gRNA sequence
tataataatagatgtagtca

SEQ ID NO: 815311 - DNA, 20 bp, Artificial
  CRISPR gRNA sequence
ttgtaattaatttattcaca

SEQ ID NO: 815312 - DNA, 20 bp, Artificial
  CRISPR gRNA sequence
tgtaattaatttattcacat

SEQ ID NO: 815313 - DNA, 20 bp, Artificial
  CRISPR gRNA sequence
gtaattaatttattcacatg

SEQ ID NO: 815314 - DNA, 20 bp, Artificial
  CRISPR gRNA sequence
taattaatttattcacatgc

SEQ ID NO: 815315 - DNA, 20 bp, Artificial
  CRISPR gRNA sequence
atttattcacatgctatcta

SEQ ID NO: 815316 - DNA, 20 bp, Artificial
  CRISPR gRNA sequence
attcacatgctatctattat

SEQ ID NO: 815317 - DNA, 20 bp, Artificial
  CRISPR gRNA sequence
ttcacatgctatctattata

SEQ ID NO: 815318 - DNA, 20 bp, Artificial
  CRISPR gRNA sequence
acatgctatctattatatat

SEQ ID NO: 815319 - DNA, 20 bp, Artificial
  CRISPR gRNA sequence
tctattatatatataatata

SEQ ID NO: 815320 - DNA, 20 bp, Artificial
  CRISPR gRNA sequence
ttatatatataatatatatt

SEQ ID NO: 815321 - DNA, 20 bp, Artificial
  CRISPR gRNA sequence
tatatataatatatattctg

SEQ ID NO: 815322 - DNA, 20 bp, Artificial
  CRISPR gRNA sequence
tgcaaatataccatgatttc

SEQ ID NO: 815323 - DNA, 20 bp, Artificial
  CRISPR gRNA sequence
caaatataccatgatttctc

SEQ ID NO: 815324 - DNA, 20 bp, Artificial
  CRISPR gRNA sequence
ctctatccattctccagttg

SEQ ID NO: 815325 - DNA, 20 bp, Artificial
  CRISPR gRNA sequence
tctatccattctccagttga

SEQ ID NO: 815326 - DNA, 20 bp, Artificial
  CRISPR gRNA sequence
tatccattctccagttgaag

SEQ ID NO: 815327 - DNA, 20 bp, Artificial
  CRISPR gRNA sequence
tccattctccagttgaagtt

SEQ ID NO: 815328 - DNA, 20 bp, Artificial
  CRISPR gRNA sequence
tccagttgaagttcttctag

SEQ ID NO: 815329 - DNA, 20 bp, Artificial
  CRISPR gRNA sequence
cagttgaagttcttctagac

SEQ ID NO: 815330 - DNA, 20 bp, Artificial
  CRISPR gRNA sequence
aagttcttctagacctactc

SEQ ID NO: 815331 - DNA, 20 bp, Artificial
  CRISPR gRNA sequence
ttctagacctactcctggaa

SEQ ID NO: 815332 - DNA, 20 bp, Artificial
  CRISPR gRNA sequence
ctagacctactcctggaatc

SEQ ID NO: 815333 - DNA, 20 bp, Artificial
  CRISPR gRNA sequence
tagacctactcctggaatca

SEQ ID NO: 815334 - DNA, 20 bp, Artificial
  CRISPR gRNA sequence
gacctactcctggaatcaaa

SEQ ID NO: 815335 - DNA, 20 bp, Artificial
  CRISPR gRNA sequence
ctcctggaatcaaattctcc

SEQ ID NO: 815336 - DNA, 20 bp, Artificial
  CRISPR gRNA sequence
ctggaatcaaattctccagg

SEQ ID NO: 815337 - DNA, 20 bp, Artificial
  CRISPR gRNA sequence
gaatcaaattctccagggca

SEQ ID NO: 815338 - DNA, 20 bp, Artificial
  CRISPR gRNA sequence
tccagggcatatggattgtt

SEQ ID NO: 815339 - DNA, 20 bp, Artificial
  CRISPR gRNA sequence
cagggcatatggattgtttt

SEQ ID NO: 815340 - DNA, 20 bp, Artificial
  CRISPR gRNA sequence
tttttatttatttgtaatga

SEQ ID NO: 815341 - DNA, 20 bp, Artificial
  CRISPR gRNA sequence
ttatttatttgtaatgactg

SEQ ID NO: 815342 - DNA, 20 bp, Artificial
  CRISPR gRNA sequence
tatttatttgtaatgactga

SEQ ID NO: 815343 - DNA, 20 bp, Artificial
  CRISPR gRNA sequence
atttatttgtaatgactgag

SEQ ID NO: 815344 - DNA, 20 bp, Artificial
  CRISPR gRNA sequence
tttatttgtaatgactgaga

SEQ ID NO: 815345 - DNA, 20 bp, Artificial
  CRISPR gRNA sequence
atttgtaatgactgagaata

SEQ ID NO: 815346 - DNA, 20 bp, Artificial
  CRISPR gRNA sequence
tttgtaatgactgagaatac

SEQ ID NO: 815347 - DNA, 20 bp, Artificial
  CRISPR gRNA sequence
gtaatgactgagaataccgc

SEQ ID NO: 815348 - DNA, 20 bp, Artificial
  CRISPR gRNA sequence
taatgactgagaataccgcc

SEQ ID NO: 815349 - DNA, 20 bp, Artificial
  CRISPR gRNA sequence
agaataccgccataagtgtt

SEQ ID NO: 815350 - DNA, 20 bp, Artificial
  CRISPR gRNA sequence
ttttttcttttttttttttt

SEQ ID NO: 815351 - DNA, 20 bp, Artificial
  CRISPR gRNA sequence
tttttctttttttttttttt

SEQ ID NO: 815352 - DNA, 20 bp, Artificial
  CRISPR gRNA sequence
ttttcttttttttttttttt

SEQ ID NO: 815353 - DNA, 20 bp, Artificial
  CRISPR gRNA sequence
tttcttttttttttttttta

SEQ ID NO: 815354 - DNA, 20 bp, Artificial
  CRISPR gRNA sequence
ttctttttttttttttttaa

SEQ ID NO: 815355 - DNA, 20 bp, Artificial
  CRISPR gRNA sequence
tctttttttttttttttaaa

SEQ ID NO: 815356 - DNA, 20 bp, Artificial
  CRISPR gRNA sequence
ctttttttttttttttaaat

SEQ ID NO: 815357 - DNA, 20 bp, Artificial
  CRISPR gRNA sequence
tttttttttttttttaaatg

SEQ ID NO: 815358 - DNA, 20 bp, Artificial
  CRISPR gRNA sequence
tttttttttttttaaatgga

SEQ ID NO: 815359 - DNA, 20 bp, Artificial
  CRISPR gRNA sequence
ttttttttttttaaatggaa

SEQ ID NO: 815360 - DNA, 20 bp, Artificial
  CRISPR gRNA sequence
tttttttttttaaatggaat

SEQ ID NO: 815361 - DNA, 20 bp, Artificial
  CRISPR gRNA sequence
ttttttttttaaatggaatc

SEQ ID NO: 815362 - DNA, 20 bp, Artificial
  CRISPR gRNA sequence
tttttttttaaatggaatct

SEQ ID NO: 815363 - DNA, 20 bp, Artificial
  CRISPR gRNA sequence
ttttttttaaatggaatctc

SEQ ID NO: 815364 - DNA, 20 bp, Artificial
  CRISPR gRNA sequence
tttttttaaatggaatctca

SEQ ID NO: 815365 - DNA, 20 bp, Artificial
  CRISPR gRNA sequence
ttttttaaatggaatctcac

SEQ ID NO: 815366 - DNA, 20 bp, Artificial
  CRISPR gRNA sequence
tttttaaatggaatctcact

SEQ ID NO: 815367 - DNA, 20 bp, Artificial
  CRISPR gRNA sequence
ttttaaatggaatctcactc

SEQ ID NO: 815368 - DNA, 20 bp, Artificial
  CRISPR gRNA sequence
tttaaatggaatctcactct

SEQ ID NO: 815369 - DNA, 20 bp, Artificial
  CRISPR gRNA sequence
ttaaatggaatctcactctg

SEQ ID NO: 815370 - DNA, 20 bp, Artificial
  CRISPR gRNA sequence
taaatggaatctcactctgt

SEQ ID NO: 815371 - DNA, 20 bp, Artificial
  CRISPR gRNA sequence
aaatggaatctcactctgtc

SEQ ID NO: 815372 - DNA, 20 bp, Artificial
  CRISPR gRNA sequence
aatggaatctcactctgtca

SEQ ID NO: 815373 - DNA, 20 bp, Artificial
  CRISPR gRNA sequence
actctgtcacccaggctgga

SEQ ID NO: 815374 - DNA, 20 bp, Artificial
  CRISPR gRNA sequence
tgtcacccaggctggaatac

SEQ ID NO: 815375 - DNA, 20 bp, Artificial
  CRISPR gRNA sequence
tcacccaggctggaatacag

SEQ ID NO: 815376 - DNA, 20 bp, Artificial
  CRISPR gRNA sequence
gaatacagtgacatgatctt

SEQ ID NO: 815377 - DNA, 20 bp, Artificial
  CRISPR gRNA sequence
agctcactgcaacctctgcc

SEQ ID NO: 815378 - DNA, 20 bp, Artificial
  CRISPR gRNA sequence
gctcactgcaacctctgcct

SEQ ID NO: 815379 - DNA, 20 bp, Artificial
  CRISPR gRNA sequence
actgcaacctctgcctcctg

SEQ ID NO: 815380 - DNA, 20 bp, Artificial
  CRISPR gRNA sequence
caacctctgcctcctgggtt

SEQ ID NO: 815381 - DNA, 20 bp, Artificial
  CRISPR gRNA sequence
tgcctcctgggttcaagcaa

SEQ ID NO: 815382 - DNA, 20 bp, Artificial
  CRISPR gRNA sequence
cctcctgggttcaagcaatt

SEQ ID NO: 815383 - DNA, 20 bp, Artificial
  CRISPR gRNA sequence
ctgggttcaagcaatttttc

SEQ ID NO: 815384 - DNA, 20 bp, Artificial
  CRISPR gRNA sequence
ggttcaagcaatttttctgc

SEQ ID NO: 815385 - DNA, 20 bp, Artificial
  CRISPR gRNA sequence
aagcaatttttctgcctcag

SEQ ID NO: 815386 - DNA, 20 bp, Artificial
  CRISPR gRNA sequence
ttctgcctcagctgagtagc

SEQ ID NO: 815387 - DNA, 20 bp, Artificial
  CRISPR gRNA sequence
tctgcctcagctgagtagct

SEQ ID NO: 815388 - DNA, 20 bp, Artificial
  CRISPR gRNA sequence
ctgcctcagctgagtagctt

SEQ ID NO: 815389 - DNA, 20 bp, Artificial
  CRISPR gRNA sequence
tgcctcagctgagtagcttg

SEQ ID NO: 815390 - DNA, 20 bp, Artificial
  CRISPR gRNA sequence
cctcagctgagtagcttgga

SEQ ID NO: 815391 - DNA, 20 bp, Artificial
  CRISPR gRNA sequence
agctgagtagcttggattat

SEQ ID NO: 815392 - DNA, 20 bp, Artificial
  CRISPR gRNA sequence
agtagcttggattataggtg

SEQ ID NO: 815393 - DNA, 20 bp, Artificial
  CRISPR gRNA sequence
ggattataggtggccaccac

SEQ ID NO: 815394 - DNA, 20 bp, Artificial
  CRISPR gRNA sequence
gattataggtggccaccacc

SEQ ID NO: 815395 - DNA, 20 bp, Artificial
  CRISPR gRNA sequence
taggtggccaccaccatgcc

SEQ ID NO: 815396 - DNA, 20 bp, Artificial
  CRISPR gRNA sequence
atatttttctatttttagta

SEQ ID NO: 815397 - DNA, 20 bp, Artificial
  CRISPR gRNA sequence
ttctatttttagtacagagg

SEQ ID NO: 815398 - DNA, 20 bp, Artificial
  CRISPR gRNA sequence
tctatttttagtacagaggg

SEQ ID NO: 815399 - DNA, 20 bp, Artificial
  CRISPR gRNA sequence
ctatttttagtacagagggg

SEQ ID NO: 815400 - DNA, 20 bp, Artificial
  CRISPR gRNA sequence
tatttttagtacagaggggt

SEQ ID NO: 815401 - DNA, 20 bp, Artificial
  CRISPR gRNA sequence
tttttagtacagaggggttt

SEQ ID NO: 815402 - DNA, 20 bp, Artificial
  CRISPR gRNA sequence
ttagtacagaggggtttcac

SEQ ID NO: 815403 - DNA, 20 bp, Artificial
  CRISPR gRNA sequence
tagtacagaggggtttcacc

SEQ ID NO: 815404 - DNA, 20 bp, Artificial
  CRISPR gRNA sequence
agtacagaggggtttcacca

SEQ ID NO: 815405 - DNA, 20 bp, Artificial
  CRISPR gRNA sequence
gtacagaggggtttcaccat

SEQ ID NO: 815406 - DNA, 20 bp, Artificial
  CRISPR gRNA sequence
caccatgttggccaggctgg

SEQ ID NO: 815407 - DNA, 20 bp, Artificial
  CRISPR gRNA sequence
accatgttggccaggctggt

SEQ ID NO: 815408 - DNA, 20 bp, Artificial
  CRISPR gRNA sequence
gccaggctggtctcgaactc

SEQ ID NO: 815409 - DNA, 20 bp, Artificial
  CRISPR gRNA sequence
gtctcgaactcctgacctga

SEQ ID NO: 815410 - DNA, 20 bp, Artificial
  CRISPR gRNA sequence
gaactcctgacctgaggtga

SEQ ID NO: 815411 - DNA, 20 bp, Artificial
  CRISPR gRNA sequence
ctgacctgaggtgatccacc

SEQ ID NO: 815412 - DNA, 20 bp, Artificial
  CRISPR gRNA sequence
acctgaggtgatccacccgc

SEQ ID NO: 815413 - DNA, 20 bp, Artificial
  CRISPR gRNA sequence
aggtgatccacccgcctcgg

SEQ ID NO: 815414 - DNA, 20 bp, Artificial
  CRISPR gRNA sequence
ggcctcccatagggctggga

SEQ ID NO: 815415 - DNA, 20 bp, Artificial
  CRISPR gRNA sequence
ccatagggctgggattatag

SEQ ID NO: 815416 - DNA, 20 bp, Artificial
  CRISPR gRNA sequence
ggattataggcgtgagccac

SEQ ID NO: 815417 - DNA, 20 bp, Artificial
  CRISPR gRNA sequence
taggcgtgagccactgcgcc

SEQ ID NO: 815418 - DNA, 20 bp, Artificial
  CRISPR gRNA sequence
cgcctggccaagtgttattt

SEQ ID NO: 815419 - DNA, 20 bp, Artificial
  CRISPR gRNA sequence
gccaagtgttatttttaaaa

SEQ ID NO: 815420 - DNA, 20 bp, Artificial
  CRISPR gRNA sequence
tttttaaaatttaaaaatag

SEQ ID NO: 815421 - DNA, 20 bp, Artificial
  CRISPR gRNA sequence
ttaaaatttaaaaatagaaa

SEQ ID NO: 815422 - DNA, 20 bp, Artificial
  CRISPR gRNA sequence
taaaatttaaaaatagaaaa

SEQ ID NO: 815423 - DNA, 20 bp, Artificial
  CRISPR gRNA sequence
aaaatttaaaaatagaaaag

SEQ ID NO: 815424 - DNA, 20 bp, Artificial
  CRISPR gRNA sequence
aaatttaaaaatagaaaaga

SEQ ID NO: 815425 - DNA, 20 bp, Artificial
  CRISPR gRNA sequence
aaaaatagaaaagaaatgtg

SEQ ID NO: 815426 - DNA, 20 bp, Artificial
  CRISPR gRNA sequence
aaaatagaaaagaaatgtgc

SEQ ID NO: 815427 - DNA, 20 bp, Artificial
  CRISPR gRNA sequence
atagggtactaagcatcaca

SEQ ID NO: 815428 - DNA, 20 bp, Artificial
  CRISPR gRNA sequence
agcatcacattgatttaatt

SEQ ID NO: 815429 - DNA, 20 bp, Artificial
  CRISPR gRNA sequence
atttaattcaggtatcttct

SEQ ID NO: 815430 - DNA, 20 bp, Artificial
  CRISPR gRNA sequence
aattcaggtatcttcttttc

SEQ ID NO: 815431 - DNA, 20 bp, Artificial
  CRISPR gRNA sequence
attcaggtatcttcttttct

SEQ ID NO: 815432 - DNA, 20 bp, Artificial
  CRISPR gRNA sequence
aggtatcttcttttcttttc

SEQ ID NO: 815433 - DNA, 20 bp, Artificial
  CRISPR gRNA sequence
cttttcttttcaatgaagca

SEQ ID NO: 815434 - DNA, 20 bp, Artificial
  CRISPR gRNA sequence
ttttcttttcaatgaagcat

SEQ ID NO: 815435 - DNA, 20 bp, Artificial
  CRISPR gRNA sequence
ttcttttcaatgaagcatgc

SEQ ID NO: 815436 - DNA, 20 bp, Artificial
  CRISPR gRNA sequence
tcttttcaatgaagcatgca

SEQ ID NO: 815437 - DNA, 20 bp, Artificial
  CRISPR gRNA sequence
cttttcaatgaagcatgcag

SEQ ID NO: 815438 - DNA, 20 bp, Artificial
  CRISPR gRNA sequence
ttttcaatgaagcatgcagg

SEQ ID NO: 815439 - DNA, 20 bp, Artificial
  CRISPR gRNA sequence
ttcaatgaagcatgcaggtc

SEQ ID NO: 815440 - DNA, 20 bp, Artificial
  CRISPR gRNA sequence
tcaatgaagcatgcaggtct

SEQ ID NO: 815441 - DNA, 20 bp, Artificial
  CRISPR gRNA sequence
caatgaagcatgcaggtctg

SEQ ID NO: 815442 - DNA, 20 bp, Artificial
  CRISPR gRNA sequence
aatgaagcatgcaggtctgg

SEQ ID NO: 815443 - DNA, 20 bp, Artificial
  CRISPR gRNA sequence
gggctgtacaaggagcaagg

SEQ ID NO: 815444 - DNA, 20 bp, Artificial
  CRISPR gRNA sequence
tacaaggagcaaggaagaaa

SEQ ID NO: 815445 - DNA, 20 bp, Artificial
  CRISPR gRNA sequence
ctgtctgtctggacaccctg

SEQ ID NO: 815446 - DNA, 20 bp, Artificial
  CRISPR gRNA sequence
tgtctgtctggacaccctga

SEQ ID NO: 815447 - DNA, 20 bp, Artificial
  CRISPR gRNA sequence
tctgtctggacaccctgata

SEQ ID NO: 815448 - DNA, 20 bp, Artificial
  CRISPR gRNA sequence
tctggacaccctgatagctg

SEQ ID NO: 815449 - DNA, 20 bp, Artificial
  CRISPR gRNA sequence
gacaccctgatagctgtagc

SEQ ID NO: 815450 - DNA, 20 bp, Artificial
  CRISPR gRNA sequence
atagctgtagctctgtctca

SEQ ID NO: 815451 - DNA, 20 bp, Artificial
  CRISPR gRNA sequence
tagctctgtctcaggcactg

SEQ ID NO: 815452 - DNA, 20 bp, Artificial
  CRISPR gRNA sequence
tgtctcaggcactgagtgtt

SEQ ID NO: 815453 - DNA, 20 bp, Artificial
  CRISPR gRNA sequence
tctcaggcactgagtgttgc

SEQ ID NO: 815454 - DNA, 20 bp, Artificial
  CRISPR gRNA sequence
aggcactgagtgttgcagtc

SEQ ID NO: 815455 - DNA, 20 bp, Artificial
  CRISPR gRNA sequence
agtgttgcagtctgattact

SEQ ID NO: 815456 - DNA, 20 bp, Artificial
  CRISPR gRNA sequence
cagtctgattactttcatat

SEQ ID NO: 815457 - DNA, 20 bp, Artificial
  CRISPR gRNA sequence
attactttcatatttttata

SEQ ID NO: 815458 - DNA, 20 bp, Artificial
  CRISPR gRNA sequence
ctttcatatttttatatgag

SEQ ID NO: 815459 - DNA, 20 bp, Artificial
  CRISPR gRNA sequence
tcatatttttatatgagaaa

SEQ ID NO: 815460 - DNA, 20 bp, Artificial
  CRISPR gRNA sequence
catatttttatatgagaaat

SEQ ID NO: 815461 - DNA, 20 bp, Artificial
  CRISPR gRNA sequence
atatttttatatgagaaatt

SEQ ID NO: 815462 - DNA, 20 bp, Artificial
  CRISPR gRNA sequence
ttatatgagaaatttcttgt

SEQ ID NO: 815463 - DNA, 20 bp, Artificial
  CRISPR gRNA sequence
tatatgagaaatttcttgta

SEQ ID NO: 815464 - DNA, 20 bp, Artificial
  CRISPR gRNA sequence
atatgagaaatttcttgtat

SEQ ID NO: 815465 - DNA, 20 bp, Artificial
  CRISPR gRNA sequence
tatgagaaatttcttgtatt

SEQ ID NO: 815466 - DNA, 20 bp, Artificial
  CRISPR gRNA sequence
cttgtatttttaaaattata

SEQ ID NO: 815467 - DNA, 20 bp, Artificial
  CRISPR gRNA sequence
ttgtatttttaaaattatat

SEQ ID NO: 815468 - DNA, 20 bp, Artificial
  CRISPR gRNA sequence
gtatttttaaaattatattt

SEQ ID NO: 815469 - DNA, 20 bp, Artificial
  CRISPR gRNA sequence
tatttttaaaattatatttt

SEQ ID NO: 815470 - DNA, 20 bp, Artificial
  CRISPR gRNA sequence
ttaaaattatattttattat

SEQ ID NO: 815471 - DNA, 20 bp, Artificial
  CRISPR gRNA sequence
taaaattatattttattata

SEQ ID NO: 815472 - DNA, 20 bp, Artificial
  CRISPR gRNA sequence
aaaattatattttattatac

SEQ ID NO: 815473 - DNA, 20 bp, Artificial
  CRISPR gRNA sequence
aaattatattttattataca

SEQ ID NO: 815474 - DNA, 20 bp, Artificial
  CRISPR gRNA sequence
tattttattatacaaataat

SEQ ID NO: 815475 - DNA, 20 bp, Artificial
  CRISPR gRNA sequence
tattatacaaataataccta

SEQ ID NO: 815476 - DNA, 20 bp, Artificial
  CRISPR gRNA sequence
attatacaaataatacctaa

SEQ ID NO: 815477 - DNA, 20 bp, Artificial
  CRISPR gRNA sequence
ttatacaaataatacctaat

SEQ ID NO: 815478 - DNA, 20 bp, Artificial
  CRISPR gRNA sequence
tacaaataatacctaataca

SEQ ID NO: 815479 - DNA, 20 bp, Artificial
  CRISPR gRNA sequence
atacatgcttcttgtaaaaa

SEQ ID NO: 815480 - DNA, 20 bp, Artificial
  CRISPR gRNA sequence
cttgtaaaaaacaaaaacct

SEQ ID NO: 815481 - DNA, 20 bp, Artificial
  CRISPR gRNA sequence
ttgtaaaaaacaaaaacctg

SEQ ID NO: 815482 - DNA, 20 bp, Artificial
  CRISPR gRNA sequence
gtaaaaaacaaaaacctgaa

SEQ ID NO: 815483 - DNA, 20 bp, Artificial
  CRISPR gRNA sequence
taaaaaacaaaaacctgaat

SEQ ID NO: 815484 - DNA, 20 bp, Artificial
  CRISPR gRNA sequence
aatatacataatagataaga

SEQ ID NO: 815485 - DNA, 20 bp, Artificial
  CRISPR gRNA sequence
tcctttttacccccatccca

SEQ ID NO: 815486 - DNA, 20 bp, Artificial
  CRISPR gRNA sequence
tttacccccatcccagacct

SEQ ID NO: 815487 - DNA, 20 bp, Artificial
  CRISPR gRNA sequence
ttacccccatcccagacctc

SEQ ID NO: 815488 - DNA, 20 bp, Artificial
  CRISPR gRNA sequence
tacccccatcccagacctcc

SEQ ID NO: 815489 - DNA, 20 bp, Artificial
  CRISPR gRNA sequence
acccccatcccagacctcct

SEQ ID NO: 815490 - DNA, 20 bp, Artificial
  CRISPR gRNA sequence
cccccatcccagacctcctc

SEQ ID NO: 815491 - DNA, 20 bp, Artificial
  CRISPR gRNA sequence
ctcccctccccagaagtaaa

SEQ ID NO: 815492 - DNA, 20 bp, Artificial
  CRISPR gRNA sequence
ccctccccagaagtaaacac

SEQ ID NO: 815493 - DNA, 20 bp, Artificial
  CRISPR gRNA sequence
cccagaagtaaacactaatt

SEQ ID NO: 815494 - DNA, 20 bp, Artificial
  CRISPR gRNA sequence
attatttctcagatccttta

SEQ ID NO: 815495 - DNA, 20 bp, Artificial
  CRISPR gRNA sequence
tttctcagatcctttagttt

SEQ ID NO: 815496 - DNA, 20 bp, Artificial
  CRISPR gRNA sequence
ctcagatcctttagtttttt

SEQ ID NO: 815497 - DNA, 20 bp, Artificial
  CRISPR gRNA sequence
tcagatcctttagttttttt

SEQ ID NO: 815498 - DNA, 20 bp, Artificial
  CRISPR gRNA sequence
agatcctttagtttttttgt

SEQ ID NO: 815499 - DNA, 20 bp, Artificial
  CRISPR gRNA sequence
tagtttttttgttgttttct

SEQ ID NO: 815500 - DNA, 20 bp, Artificial
  CRISPR gRNA sequence
agtttttttgttgttttctt

SEQ ID NO: 815501 - DNA, 20 bp, Artificial
  CRISPR gRNA sequence
gtttttttgttgttttcttt

SEQ ID NO: 815502 - DNA, 20 bp, Artificial
  CRISPR gRNA sequence
ttttgttgttttcttttgca

SEQ ID NO: 815503 - DNA, 20 bp, Artificial
  CRISPR gRNA sequence
tttgttgttttcttttgcag

SEQ ID NO: 815504 - DNA, 20 bp, Artificial
  CRISPR gRNA sequence
ttgttgttttcttttgcagg

SEQ ID NO: 815505 - DNA, 20 bp, Artificial
  CRISPR gRNA sequence
tgttgttttcttttgcaggt

SEQ ID NO: 815506 - DNA, 20 bp, Artificial
  CRISPR gRNA sequence
gttgttttcttttgcaggta

SEQ ID NO: 815507 - DNA, 20 bp, Artificial
  CRISPR gRNA sequence
ttgttttcttttgcaggtac

SEQ ID NO: 815508 - DNA, 20 bp, Artificial
  CRISPR gRNA sequence
ttttcttttgcaggtaccct

SEQ ID NO: 815509 - DNA, 20 bp, Artificial
  CRISPR gRNA sequence
tcttttgcaggtaccctcct

SEQ ID NO: 815510 - DNA, 20 bp, Artificial
  CRISPR gRNA sequence
cttttgcaggtaccctcctc

SEQ ID NO: 815511 - DNA, 20 bp, Artificial
  CRISPR gRNA sequence
ttttgcaggtaccctcctct

SEQ ID NO: 815512 - DNA, 20 bp, Artificial
  CRISPR gRNA sequence
ttgcaggtaccctcctctga

SEQ ID NO: 815513 - DNA, 20 bp, Artificial
  CRISPR gRNA sequence
tgcaggtaccctcctctgaa

SEQ ID NO: 815514 - DNA, 20 bp, Artificial
  CRISPR gRNA sequence
gcaggtaccctcctctgaaa

SEQ ID NO: 815515 - DNA, 20 bp, Artificial
  CRISPR gRNA sequence
caggtaccctcctctgaaat

SEQ ID NO: 815516 - DNA, 20 bp, Artificial
  CRISPR gRNA sequence
ctctgaaatcaaaactcttt

SEQ ID NO: 815517 - DNA, 20 bp, Artificial
  CRISPR gRNA sequence
tgaaatcaaaactctttaat

SEQ ID NO: 815518 - DNA, 20 bp, Artificial
  CRISPR gRNA sequence
aaatcaaaactctttaatta

SEQ ID NO: 815519 - DNA, 20 bp, Artificial
  CRISPR gRNA sequence
tttaattaaagagacatgaa

SEQ ID NO: 815520 - DNA, 20 bp, Artificial
  CRISPR gRNA sequence
taattaaagagacatgaaat

SEQ ID NO: 815521 - DNA, 20 bp, Artificial
  CRISPR gRNA sequence
aattaaagagacatgaaatg

SEQ ID NO: 815522 - DNA, 20 bp, Artificial
  CRISPR gRNA sequence
attaaagagacatgaaatga

SEQ ID NO: 815523 - DNA, 20 bp, Artificial
  CRISPR gRNA sequence
aagagacatgaaatgacaag

SEQ ID NO: 815524 - DNA, 20 bp, Artificial
  CRISPR gRNA sequence
taaaaaaatcccatgaggag

SEQ ID NO: 815525 - DNA, 20 bp, Artificial
  CRISPR gRNA sequence
aaaaaaatcccatgaggaga

SEQ ID NO: 815526 - DNA, 20 bp, Artificial
  CRISPR gRNA sequence
aaaaaatcccatgaggagaa

SEQ ID NO: 815527 - DNA, 20 bp, Artificial
  CRISPR gRNA sequence
taatttaggtaggtatttaa

SEQ ID NO: 815528 - DNA, 20 bp, Artificial
  CRISPR gRNA sequence
atttaggtaggtatttaata

SEQ ID NO: 815529 - DNA, 20 bp, Artificial
  CRISPR gRNA sequence
aggtaggtatttaatatttg

SEQ ID NO: 815530 - DNA, 20 bp, Artificial
  CRISPR gRNA sequence
ggtaggtatttaatatttgt

SEQ ID NO: 815531 - DNA, 20 bp, Artificial
  CRISPR gRNA sequence
aatatttgtctgaactgatg

SEQ ID NO: 815532 - DNA, 20 bp, Artificial
  CRISPR gRNA sequence
atatttgtctgaactgatgt

SEQ ID NO: 815533 - DNA, 20 bp, Artificial
  CRISPR gRNA sequence
gtctgaactgatgttatctg

SEQ ID NO: 815534 - DNA, 20 bp, Artificial
  CRISPR gRNA sequence
tctgaactgatgttatctgc

SEQ ID NO: 815535 - DNA, 20 bp, Artificial
  CRISPR gRNA sequence
aactgatgttatctgcatag

SEQ ID NO: 815536 - DNA, 20 bp, Artificial
  CRISPR gRNA sequence
atgttatctgcatagtggaa

SEQ ID NO: 815537 - DNA, 20 bp, Artificial
  CRISPR gRNA sequence
tctgcatagtggaaagcaga

SEQ ID NO: 815538 - DNA, 20 bp, Artificial
  CRISPR gRNA sequence
catagtggaaagcagaaaag

SEQ ID NO: 815539 - DNA, 20 bp, Artificial
  CRISPR gRNA sequence
caaattcgtgaagaaaatga

SEQ ID NO: 815540 - DNA, 20 bp, Artificial
  CRISPR gRNA sequence
gtgaagaaaatgagaaagcg

SEQ ID NO: 815541 - DNA, 20 bp, Artificial
  CRISPR gRNA sequence
catttttactttcctttcag

SEQ ID NO: 815542 - DNA, 20 bp, Artificial
  CRISPR gRNA sequence
ttactttcctttcagttaat

SEQ ID NO: 815543 - DNA, 20 bp, Artificial
  CRISPR gRNA sequence
tactttcctttcagttaatt

SEQ ID NO: 815544 - DNA, 20 bp, Artificial
  CRISPR gRNA sequence
actttcctttcagttaattc

SEQ ID NO: 815545 - DNA, 20 bp, Artificial
  CRISPR gRNA sequence
ctttcctttcagttaattca

SEQ ID NO: 815546 - DNA, 20 bp, Artificial
  CRISPR gRNA sequence
tcctttcagttaattcagca

SEQ ID NO: 815547 - DNA, 20 bp, Artificial
  CRISPR gRNA sequence
cctttcagttaattcagcaa

SEQ ID NO: 815548 - DNA, 20 bp, Artificial
  CRISPR gRNA sequence
ctttcagttaattcagcaac

SEQ ID NO: 815549 - DNA, 20 bp, Artificial
  CRISPR gRNA sequence
tcagttaattcagcaacata

SEQ ID NO: 815550 - DNA, 20 bp, Artificial
  CRISPR gRNA sequence
cagttaattcagcaacataa

SEQ ID NO: 815551 - DNA, 20 bp, Artificial
  CRISPR gRNA sequence
agttaattcagcaacataat

SEQ ID NO: 815552 - DNA, 20 bp, Artificial
  CRISPR gRNA sequence
attcagcaacataattcatt

SEQ ID NO: 815553 - DNA, 20 bp, Artificial
  CRISPR gRNA sequence
agcaacataattcattacac

SEQ ID NO: 815554 - DNA, 20 bp, Artificial
  CRISPR gRNA sequence
attacacatattttttgatt

SEQ ID NO: 815555 - DNA, 20 bp, Artificial
  CRISPR gRNA sequence
cacatattttttgattctgt

SEQ ID NO: 815556 - DNA, 20 bp, Artificial
  CRISPR gRNA sequence
tttgattctgtgaatatcca

SEQ ID NO: 815557 - DNA, 20 bp, Artificial
  CRISPR gRNA sequence
ttgattctgtgaatatccag

SEQ ID NO: 815558 - DNA, 20 bp, Artificial
  CRISPR gRNA sequence
tgattctgtgaatatccaga

SEQ ID NO: 815559 - DNA, 20 bp, Artificial
  CRISPR gRNA sequence
gattctgtgaatatccagaa

SEQ ID NO: 815560 - DNA, 20 bp, Artificial
  CRISPR gRNA sequence
attctgtgaatatccagaat

SEQ ID NO: 815561 - DNA, 20 bp, Artificial
  CRISPR gRNA sequence
tgtgaatatccagaataaac

SEQ ID NO: 815562 - DNA, 20 bp, Artificial
  CRISPR gRNA sequence
tgaatatccagaataaacat

SEQ ID NO: 815563 - DNA, 20 bp, Artificial
  CRISPR gRNA sequence
aatacgtatccatattcaga

SEQ ID NO: 815564 - DNA, 20 bp, Artificial
  CRISPR gRNA sequence
agacttcagtgcaaaaacct

SEQ ID NO: 815565 - DNA, 20 bp, Artificial
  CRISPR gRNA sequence
cagtgcaaaaacctattcca

SEQ ID NO: 815566 - DNA, 20 bp, Artificial
  CRISPR gRNA sequence
agtgcaaaaacctattccaa

SEQ ID NO: 815567 - DNA, 20 bp, Artificial
  CRISPR gRNA sequence
ttccaaagttggaagattta

SEQ ID NO: 815568 - DNA, 20 bp, Artificial
  CRISPR gRNA sequence
caaagttggaagatttatgg

SEQ ID NO: 815569 - DNA, 20 bp, Artificial
  CRISPR gRNA sequence
gaagatttatgggttgtctg

SEQ ID NO: 815570 - DNA, 20 bp, Artificial
  CRISPR gRNA sequence
atgggttgtctgccattttt

SEQ ID NO: 815571 - DNA, 20 bp, Artificial
  CRISPR gRNA sequence
tgggttgtctgccatttttg

SEQ ID NO: 815572 - DNA, 20 bp, Artificial
  CRISPR gRNA sequence
tctgccatttttgattacca

SEQ ID NO: 815573 - DNA, 20 bp, Artificial
  CRISPR gRNA sequence
ccatttttgattaccatcat

SEQ ID NO: 815574 - DNA, 20 bp, Artificial
  CRISPR gRNA sequence
ttgattaccatcatcatggt

SEQ ID NO: 815575 - DNA, 20 bp, Artificial
  CRISPR gRNA sequence
tgattaccatcatcatggta

SEQ ID NO: 815576 - DNA, 20 bp, Artificial
  CRISPR gRNA sequence
gattaccatcatcatggtag

SEQ ID NO: 815577 - DNA, 20 bp, Artificial
  CRISPR gRNA sequence
attaccatcatcatggtagc

SEQ ID NO: 815578 - DNA, 20 bp, Artificial
  CRISPR gRNA sequence
ccatcatcatggtagcacag

SEQ ID NO: 815579 - DNA, 20 bp, Artificial
  CRISPR gRNA sequence
gctttgttgaaatcttgccg

SEQ ID NO: 815580 - DNA, 20 bp, Artificial
  CRISPR gRNA sequence
tgttgaaatcttgccggtgt

SEQ ID NO: 815581 - DNA, 20 bp, Artificial
  CRISPR gRNA sequence
gttgaaatcttgccggtgtc

SEQ ID NO: 815582 - DNA, 20 bp, Artificial
  CRISPR gRNA sequence
ttgaaatcttgccggtgtca

SEQ ID NO: 815583 - DNA, 20 bp, Artificial
  CRISPR gRNA sequence
aaatcttgccggtgtcacct

SEQ ID NO: 815584 - DNA, 20 bp, Artificial
  CRISPR gRNA sequence
gccggtgtcacctaataact

SEQ ID NO: 815585 - DNA, 20 bp, Artificial
  CRISPR gRNA sequence
ccggtgtcacctaataacta

SEQ ID NO: 815586 - DNA, 20 bp, Artificial
  CRISPR gRNA sequence
ataactatgtaatcttgggg

SEQ ID NO: 815587 - DNA, 20 bp, Artificial
  CRISPR gRNA sequence
tgtaatcttggggaaattaa

SEQ ID NO: 815588 - DNA, 20 bp, Artificial
  CRISPR gRNA sequence
ggggaaattaagtacctttt

SEQ ID NO: 815589 - DNA, 20 bp, Artificial
  CRISPR gRNA sequence
gggaaattaagtaccttttc

SEQ ID NO: 815590 - DNA, 20 bp, Artificial
  CRISPR gRNA sequence
agtaccttttctgagttcta

SEQ ID NO: 815591 - DNA, 20 bp, Artificial
  CRISPR gRNA sequence
ttctgagttctagttccctc

SEQ ID NO: 815592 - DNA, 20 bp, Artificial
  CRISPR gRNA sequence
tctgagttctagttccctca

SEQ ID NO: 815593 - DNA, 20 bp, Artificial
  CRISPR gRNA sequence
ctgagttctagttccctcac

SEQ ID NO: 815594 - DNA, 20 bp, Artificial
  CRISPR gRNA sequence
tgagttctagttccctcacc

SEQ ID NO: 815595 - DNA, 20 bp, Artificial
  CRISPR gRNA sequence
agttctagttccctcacctg

SEQ ID NO: 815596 - DNA, 20 bp, Artificial
  CRISPR gRNA sequence
tagttccctcacctgcaaaa

SEQ ID NO: 815597 - DNA, 20 bp, Artificial
  CRISPR gRNA sequence
gttccctcacctgcaaaatg

SEQ ID NO: 815598 - DNA, 20 bp, Artificial
  CRISPR gRNA sequence
cctcacctgcaaaatgatca

SEQ ID NO: 815599 - DNA, 20 bp, Artificial
  CRISPR gRNA sequence
acctgcaaaatgatcattgt

SEQ ID NO: 815600 - DNA, 20 bp, Artificial
  CRISPR gRNA sequence
caaaatgatcattgtgaaga

SEQ ID NO: 815601 - DNA, 20 bp, Artificial
  CRISPR gRNA sequence
tgaagattaaatgaactata

SEQ ID NO: 815602 - DNA, 20 bp, Artificial
  CRISPR gRNA sequence
aatgaactataccatatgta

SEQ ID NO: 815603 - DNA, 20 bp, Artificial
  CRISPR gRNA sequence
taccatatgtaaattgccta

SEQ ID NO: 815604 - DNA, 20 bp, Artificial
  CRISPR gRNA sequence
cctagcacagtatctggcat

SEQ ID NO: 815605 - DNA, 20 bp, Artificial
  CRISPR gRNA sequence
gcacagtatctggcatttag

SEQ ID NO: 815606 - DNA, 20 bp, Artificial
  CRISPR gRNA sequence
gcatttagtgaatcttcaat

SEQ ID NO: 815607 - DNA, 20 bp, Artificial
  CRISPR gRNA sequence
agtgaatcttcaataaatgt

SEQ ID NO: 815608 - DNA, 20 bp, Artificial
  CRISPR gRNA sequence
gtgaatcttcaataaatgta

SEQ ID NO: 815609 - DNA, 20 bp, Artificial
  CRISPR gRNA sequence
caataaatgtaaatgctctt

SEQ ID NO: 815610 - DNA, 20 bp, Artificial
  CRISPR gRNA sequence
aataaatgtaaatgctcttc

SEQ ID NO: 815611 - DNA, 20 bp, Artificial
  CRISPR gRNA sequence
ttccttttgccccattagta

SEQ ID NO: 815612 - DNA, 20 bp, Artificial
  CRISPR gRNA sequence
ccttttgccccattagtata

SEQ ID NO: 815613 - DNA, 20 bp, Artificial
  CRISPR gRNA sequence
cttttgccccattagtatac

SEQ ID NO: 815614 - DNA, 20 bp, Artificial
  CRISPR gRNA sequence
ttgccccattagtataccta

SEQ ID NO: 815615 - DNA, 20 bp, Artificial
  CRISPR gRNA sequence
tgccccattagtatacctaa

SEQ ID NO: 815616 - DNA, 20 bp, Artificial
  CRISPR gRNA sequence
gccccattagtatacctaac

SEQ ID NO: 815617 - DNA, 20 bp, Artificial
  CRISPR gRNA sequence
ccccattagtatacctaact

SEQ ID NO: 815618 - DNA, 20 bp, Artificial
  CRISPR gRNA sequence
gtatacctaactgggagcta

SEQ ID NO: 815619 - DNA, 20 bp, Artificial
  CRISPR gRNA sequence
actgggagctagtgcctatc

SEQ ID NO: 815620 - DNA, 20 bp, Artificial
  CRISPR gRNA sequence
ggagctagtgcctatcttca

SEQ ID NO: 815621 - DNA, 20 bp, Artificial
  CRISPR gRNA sequence
gtgcctatcttcattgtctt

SEQ ID NO: 815622 - DNA, 20 bp, Artificial
  CRISPR gRNA sequence
tcttcattgtcttgtgctga

SEQ ID NO: 815623 - DNA, 20 bp, Artificial
  CRISPR gRNA sequence
cattgtcttgtgctgattat

SEQ ID NO: 815624 - DNA, 20 bp, Artificial
  CRISPR gRNA sequence
attgtcttgtgctgattatc

SEQ ID NO: 815625 - DNA, 20 bp, Artificial
  CRISPR gRNA sequence
tcttgtgctgattatcttag

SEQ ID NO: 815626 - DNA, 20 bp, Artificial
  CRISPR gRNA sequence
gtgctgattatcttagaaga

SEQ ID NO: 815627 - DNA, 20 bp, Artificial
  CRISPR gRNA sequence
tgctgattatcttagaagaa

SEQ ID NO: 815628 - DNA, 20 bp, Artificial
  CRISPR gRNA sequence
attatcttagaagaaaagat

SEQ ID NO: 815629 - DNA, 20 bp, Artificial
  CRISPR gRNA sequence
tcttagaagaaaagatcctt

SEQ ID NO: 815630 - DNA, 20 bp, Artificial
  CRISPR gRNA sequence
agaagaaaagatccttcctc

SEQ ID NO: 815631 - DNA, 20 bp, Artificial
  CRISPR gRNA sequence
gaagaaaagatccttcctct

SEQ ID NO: 815632 - DNA, 20 bp, Artificial
  CRISPR gRNA sequence
cctctgtagaaagagccaat

SEQ ID NO: 815633 - DNA, 20 bp, Artificial
  CRISPR gRNA sequence
ctctgtagaaagagccaatg

SEQ ID NO: 815634 - DNA, 20 bp, Artificial
  CRISPR gRNA sequence
tgtagaaagagccaatgagg

SEQ ID NO: 815635 - DNA, 20 bp, Artificial
  CRISPR gRNA sequence
tagaaagagccaatgaggga

SEQ ID NO: 815636 - DNA, 20 bp, Artificial
  CRISPR gRNA sequence
ccccttgtcaccctagctca

SEQ ID NO: 815637 - DNA, 20 bp, Artificial
  CRISPR gRNA sequence
gtcaccctagctcactcctt

SEQ ID NO: 815638 - DNA, 20 bp, Artificial
  CRISPR gRNA sequence
tcaccctagctcactccttt

SEQ ID NO: 815639 - DNA, 20 bp, Artificial
  CRISPR gRNA sequence
gctcactcctttcctaagag

SEQ ID NO: 815640 - DNA, 20 bp, Artificial
  CRISPR gRNA sequence
actcctttcctaagagaaaa

SEQ ID NO: 815641 - DNA, 20 bp, Artificial
  CRISPR gRNA sequence
ctttcctaagagaaaaggca

SEQ ID NO: 815642 - DNA, 20 bp, Artificial
  CRISPR gRNA sequence
tcctaagagaaaaggcaaaa

SEQ ID NO: 815643 - DNA, 20 bp, Artificial
  CRISPR gRNA sequence
cctaagagaaaaggcaaaaa

SEQ ID NO: 815644 - DNA, 20 bp, Artificial
  CRISPR gRNA sequence
ctaagagaaaaggcaaaaaa

SEQ ID NO: 815645 - DNA, 20 bp, Artificial
  CRISPR gRNA sequence
agagaaaaggcaaaaaacaa

SEQ ID NO: 815646 - DNA, 20 bp, Artificial
  CRISPR gRNA sequence
agtgtttttaagctacaaac

SEQ ID NO: 815647 - DNA, 20 bp, Artificial
  CRISPR gRNA sequence
ttaagctacaaacccacaga

SEQ ID NO: 815648 - DNA, 20 bp, Artificial
  CRISPR gRNA sequence
taagctacaaacccacagag

SEQ ID NO: 815649 - DNA, 20 bp, Artificial
  CRISPR gRNA sequence
aagctacaaacccacagagg

SEQ ID NO: 815650 - DNA, 20 bp, Artificial
  CRISPR gRNA sequence
agctacaaacccacagaggt

SEQ ID NO: 815651 - DNA, 20 bp, Artificial
  CRISPR gRNA sequence
caaacccacagaggttacac

SEQ ID NO: 815652 - DNA, 20 bp, Artificial
  CRISPR gRNA sequence
cacattccccaagttttctc

SEQ ID NO: 815653 - DNA, 20 bp, Artificial
  CRISPR gRNA sequence
cccaagttttctcctgaagc

SEQ ID NO: 815654 - DNA, 20 bp, Artificial
  CRISPR gRNA sequence
tctcctgaagcccccagtcc

SEQ ID NO: 815655 - DNA, 20 bp, Artificial
  CRISPR gRNA sequence
ctcctgaagcccccagtcct

SEQ ID NO: 815656 - DNA, 20 bp, Artificial
  CRISPR gRNA sequence
tcctgaagcccccagtcctg

SEQ ID NO: 815657 - DNA, 20 bp, Artificial
  CRISPR gRNA sequence
ctgaagcccccagtcctgcc

SEQ ID NO: 815658 - DNA, 20 bp, Artificial
  CRISPR gRNA sequence
aagcccccagtcctgccaca

SEQ ID NO: 815659 - DNA, 20 bp, Artificial
  CRISPR gRNA sequence
ccacaggatggggaacagtg

SEQ ID NO: 815660 - DNA, 20 bp, Artificial
  CRISPR gRNA sequence
ttggccctcatttcccttat

SEQ ID NO: 815661 - DNA, 20 bp, Artificial
  CRISPR gRNA sequence
tggccctcatttcccttatc

SEQ ID NO: 815662 - DNA, 20 bp, Artificial
  CRISPR gRNA sequence
ggccctcatttcccttatca

SEQ ID NO: 815663 - DNA, 20 bp, Artificial
  CRISPR gRNA sequence
gccctcatttcccttatcac

SEQ ID NO: 815664 - DNA, 20 bp, Artificial
  CRISPR gRNA sequence
atttcccttatcactctatg

SEQ ID NO: 815665 - DNA, 20 bp, Artificial
  CRISPR gRNA sequence
cccttatcactctatggaaa

SEQ ID NO: 815666 - DNA, 20 bp, Artificial
  CRISPR gRNA sequence
ccttatcactctatggaaac

SEQ ID NO: 815667 - DNA, 20 bp, Artificial
  CRISPR gRNA sequence
atcactctatggaaacttga

SEQ ID NO: 815668 - DNA, 20 bp, Artificial
  CRISPR gRNA sequence
tcactctatggaaacttgaa

SEQ ID NO: 815669 - DNA, 20 bp, Artificial
  CRISPR gRNA sequence
tatggaaacttgaagctgtt

SEQ ID NO: 815670 - DNA, 20 bp, Artificial
  CRISPR gRNA sequence
tggaaacttgaagctgtttt

SEQ ID NO: 815671 - DNA, 20 bp, Artificial
  CRISPR gRNA sequence
gaagctgttttgtagcaagg

SEQ ID NO: 815672 - DNA, 20 bp, Artificial
  CRISPR gRNA sequence
aagctgttttgtagcaagga

SEQ ID NO: 815673 - DNA, 20 bp, Artificial
  CRISPR gRNA sequence
ttttgtagcaaggaagttat

SEQ ID NO: 815674 - DNA, 20 bp, Artificial
  CRISPR gRNA sequence
tgtagcaaggaagttattgc

SEQ ID NO: 815675 - DNA, 20 bp, Artificial
  CRISPR gRNA sequence
gtagcaaggaagttattgcc

SEQ ID NO: 815676 - DNA, 20 bp, Artificial
  CRISPR gRNA sequence
tagcaaggaagttattgccc

SEQ ID NO: 815677 - DNA, 20 bp, Artificial
  CRISPR gRNA sequence
ttgccccttttgcttgtctc

SEQ ID NO: 815678 - DNA, 20 bp, Artificial
  CRISPR gRNA sequence
ccccttttgcttgtctctaa

SEQ ID NO: 815679 - DNA, 20 bp, Artificial
  CRISPR gRNA sequence
ttgcttgtctctaaaatgcc

SEQ ID NO: 815680 - DNA, 20 bp, Artificial
  CRISPR gRNA sequence
tgcttgtctctaaaatgcca

SEQ ID NO: 815681 - DNA, 20 bp, Artificial
  CRISPR gRNA sequence
gcttgtctctaaaatgccag

SEQ ID NO: 815682 - DNA, 20 bp, Artificial
  CRISPR gRNA sequence
cttgtctctaaaatgccagc

SEQ ID NO: 815683 - DNA, 20 bp, Artificial
  CRISPR gRNA sequence
gtctctaaaatgccagccag

SEQ ID NO: 815684 - DNA, 20 bp, Artificial
  CRISPR gRNA sequence
tctctaaaatgccagccagg

SEQ ID NO: 815685 - DNA, 20 bp, Artificial
  CRISPR gRNA sequence
taaaatgccagccaggcagg

SEQ ID NO: 815686 - DNA, 20 bp, Artificial
  CRISPR gRNA sequence
aaatgccagccaggcagggt

SEQ ID NO: 815687 - DNA, 20 bp, Artificial
  CRISPR gRNA sequence
cttgcaaagaaaacatgaaa

SEQ ID NO: 815688 - DNA, 20 bp, Artificial
  CRISPR gRNA sequence
gcaaagaaaacatgaaaagt

SEQ ID NO: 815689 - DNA, 20 bp, Artificial
  CRISPR gRNA sequence
caaagaaaacatgaaaagtt

SEQ ID NO: 815690 - DNA, 20 bp, Artificial
  CRISPR gRNA sequence
ctttagctggccctgcaggc

SEQ ID NO: 815691 - DNA, 20 bp, Artificial
  CRISPR gRNA sequence
tagctggccctgcaggcagg

SEQ ID NO: 815692 - DNA, 20 bp, Artificial
  CRISPR gRNA sequence
agctggccctgcaggcagga

SEQ ID NO: 815693 - DNA, 20 bp, Artificial
  CRISPR gRNA sequence
gctggccctgcaggcaggag

SEQ ID NO: 815694 - DNA, 20 bp, Artificial
  CRISPR gRNA sequence
gccctgcaggcaggagcaga

SEQ ID NO: 815695 - DNA, 20 bp, Artificial
  CRISPR gRNA sequence
caggcaggagcagagtagaa

SEQ ID NO: 815696 - DNA, 20 bp, Artificial
  CRISPR gRNA sequence
agggtcttcctttgaggagg

SEQ ID NO: 815697 - DNA, 20 bp, Artificial
  CRISPR gRNA sequence
cctttgaggagggccccaag

SEQ ID NO: 815698 - DNA, 20 bp, Artificial
  CRISPR gRNA sequence
ctttgaggagggccccaagt

SEQ ID NO: 815699 - DNA, 20 bp, Artificial
  CRISPR gRNA sequence
tgaggagggccccaagtgca

SEQ ID NO: 815700 - DNA, 20 bp, Artificial
  CRISPR gRNA sequence
gaggagggccccaagtgcat

SEQ ID NO: 815701 - DNA, 20 bp, Artificial
  CRISPR gRNA sequence
aggagggccccaagtgcatg

SEQ ID NO: 815702 - DNA, 20 bp, Artificial
  CRISPR gRNA sequence
tagtgccagaccaggctggg

SEQ ID NO: 815703 - DNA, 20 bp, Artificial
  CRISPR gRNA sequence
gtgccagaccaggctgggca

SEQ ID NO: 815704 - DNA, 20 bp, Artificial
  CRISPR gRNA sequence
ggcagctcaagtgagtgaga

SEQ ID NO: 815705 - DNA, 20 bp, Artificial
  CRISPR gRNA sequence
aagtgagtgagaggaatgtg

SEQ ID NO: 815706 - DNA, 20 bp, Artificial
  CRISPR gRNA sequence
ggtgaagagtgatctggaac

SEQ ID NO: 815707 - DNA, 20 bp, Artificial
  CRISPR gRNA sequence
gaaccagctagtagggagga

SEQ ID NO: 815708 - DNA, 20 bp, Artificial
  CRISPR gRNA sequence
gtagggaggagaaagctctt

SEQ ID NO: 815709 - DNA, 20 bp, Artificial
  CRISPR gRNA sequence
ttcgaaaggttatcaagtgc

SEQ ID NO: 815710 - DNA, 20 bp, Artificial
  CRISPR gRNA sequence
cgaaaggttatcaagtgcca

SEQ ID NO: 815711 - DNA, 20 bp, Artificial
  CRISPR gRNA sequence
gaaaggttatcaagtgccaa

SEQ ID NO: 815712 - DNA, 20 bp, Artificial
  CRISPR gRNA sequence
tcaagtgccaagggagccat

SEQ ID NO: 815713 - DNA, 20 bp, Artificial
  CRISPR gRNA sequence
tttctcaatcatgagcagaa

SEQ ID NO: 815714 - DNA, 20 bp, Artificial
  CRISPR gRNA sequence
ctcaatcatgagcagaaaga

SEQ ID NO: 815715 - DNA, 20 bp, Artificial
  CRISPR gRNA sequence
tcaatcatgagcagaaagat

SEQ ID NO: 815716 - DNA, 20 bp, Artificial
  CRISPR gRNA sequence
aatcatgagcagaaagatga

SEQ ID NO: 815717 - DNA, 20 bp, Artificial
  CRISPR gRNA sequence
cccatggggctggggctatt

SEQ ID NO: 815718 - DNA, 20 bp, Artificial
  CRISPR gRNA sequence
ccatggggctggggctattg

SEQ ID NO: 815719 - DNA, 20 bp, Artificial
  CRISPR gRNA sequence
gggctattgtcttgaggact

SEQ ID NO: 815720 - DNA, 20 bp, Artificial
  CRISPR gRNA sequence
ttgtcttgaggacttaatcc

SEQ ID NO: 815721 - DNA, 20 bp, Artificial
  CRISPR gRNA sequence
tcttgaggacttaatcctct

SEQ ID NO: 815722 - DNA, 20 bp, Artificial
  CRISPR gRNA sequence
gaggacttaatcctctgtcc

SEQ ID NO: 815723 - DNA, 20 bp, Artificial
  CRISPR gRNA sequence
aggacttaatcctctgtcca

SEQ ID NO: 815724 - DNA, 20 bp, Artificial
  CRISPR gRNA sequence
aatcctctgtccacacctct

SEQ ID NO: 815725 - DNA, 20 bp, Artificial
  CRISPR gRNA sequence
atcctctgtccacacctcta

SEQ ID NO: 815726 - DNA, 20 bp, Artificial
  CRISPR gRNA sequence
tgtccacacctctatgttac

SEQ ID NO: 815727 - DNA, 20 bp, Artificial
  CRISPR gRNA sequence
tccacacctctatgttactc

SEQ ID NO: 815728 - DNA, 20 bp, Artificial
  CRISPR gRNA sequence
tatgttactctcttagctcc

SEQ ID NO: 815729 - DNA, 20 bp, Artificial
  CRISPR gRNA sequence
tgttactctcttagctcctg

SEQ ID NO: 815730 - DNA, 20 bp, Artificial
  CRISPR gRNA sequence
ctctcttagctcctggtgtt

SEQ ID NO: 815731 - DNA, 20 bp, Artificial
  CRISPR gRNA sequence
tcttagctcctggtgttcat

SEQ ID NO: 815732 - DNA, 20 bp, Artificial
  CRISPR gRNA sequence
ttagctcctggtgttcatcc

SEQ ID NO: 815733 - DNA, 20 bp, Artificial
  CRISPR gRNA sequence
agctcctggtgttcatccaa

SEQ ID NO: 815734 - DNA, 20 bp, Artificial
  CRISPR gRNA sequence
gctcctggtgttcatccaaa

SEQ ID NO: 815735 - DNA, 20 bp, Artificial
  CRISPR gRNA sequence
ctggtgttcatccaaaatag

SEQ ID NO: 815736 - DNA, 20 bp, Artificial
  CRISPR gRNA sequence
gtgttcatccaaaatagtgc

SEQ ID NO: 815737 - DNA, 20 bp, Artificial
  CRISPR gRNA sequence
atccaaaatagtgcactcat

SEQ ID NO: 815738 - DNA, 20 bp, Artificial
  CRISPR gRNA sequence
atggttctaactacaccctc

SEQ ID NO: 815739 - DNA, 20 bp, Artificial
  CRISPR gRNA sequence
taactacaccctcgaatggt

SEQ ID NO: 815740 - DNA, 20 bp, Artificial
  CRISPR gRNA sequence
actacaccctcgaatggtct

SEQ ID NO: 815741 - DNA, 20 bp, Artificial
  CRISPR gRNA sequence
caccctcgaatggtctgaac

SEQ ID NO: 815742 - DNA, 20 bp, Artificial
  CRISPR gRNA sequence
gaatggtctgaactaccttc

SEQ ID NO: 815743 - DNA, 20 bp, Artificial
  CRISPR gRNA sequence
aactaccttccccaggagaa

SEQ ID NO: 815744 - DNA, 20 bp, Artificial
  CRISPR gRNA sequence
ccttccccaggagaacaacc

SEQ ID NO: 815745 - DNA, 20 bp, Artificial
  CRISPR gRNA sequence
ccccaggagaacaaccaact

SEQ ID NO: 815746 - DNA, 20 bp, Artificial
  CRISPR gRNA sequence
cccaggagaacaaccaactg

SEQ ID NO: 815747 - DNA, 20 bp, Artificial
  CRISPR gRNA sequence
tgaaactgcttttctttctg

SEQ ID NO: 815748 - DNA, 20 bp, Artificial
  CRISPR gRNA sequence
cttttctttctgctcaccct

SEQ ID NO: 815749 - DNA, 20 bp, Artificial
  CRISPR gRNA sequence
ttctttctgctcaccctcat

SEQ ID NO: 815750 - DNA, 20 bp, Artificial
  CRISPR gRNA sequence
tctttctgctcaccctcatc

SEQ ID NO: 815751 - DNA, 20 bp, Artificial
  CRISPR gRNA sequence
ctttctgctcaccctcatcc

SEQ ID NO: 815752 - DNA, 20 bp, Artificial
  CRISPR gRNA sequence
tttctgctcaccctcatcct

SEQ ID NO: 815753 - DNA, 20 bp, Artificial
  CRISPR gRNA sequence
tctgctcaccctcatcctcc

SEQ ID NO: 815754 - DNA, 20 bp, Artificial
  CRISPR gRNA sequence
ctgctcaccctcatcctcca

SEQ ID NO: 815755 - DNA, 20 bp, Artificial
  CRISPR gRNA sequence
tgctcaccctcatcctccaa

SEQ ID NO: 815756 - DNA, 20 bp, Artificial
  CRISPR gRNA sequence
ctcaccctcatcctccaata

SEQ ID NO: 815757 - DNA, 20 bp, Artificial
  CRISPR gRNA sequence
accctcatcctccaatagaa

SEQ ID NO: 815758 - DNA, 20 bp, Artificial
  CRISPR gRNA sequence
atcctccaatagaagtcctt

SEQ ID NO: 815759 - DNA, 20 bp, Artificial
  CRISPR gRNA sequence
caatagaagtcctttcttca

SEQ ID NO: 815760 - DNA, 20 bp, Artificial
  CRISPR gRNA sequence
tcttcaagtccaaagggata

SEQ ID NO: 815761 - DNA, 20 bp, Artificial
  CRISPR gRNA sequence
cttcaagtccaaagggatag

SEQ ID NO: 815762 - DNA, 20 bp, Artificial
  CRISPR gRNA sequence
ttcaagtccaaagggatagc

SEQ ID NO: 815763 - DNA, 20 bp, Artificial
  CRISPR gRNA sequence
caagtccaaagggatagcct

SEQ ID NO: 815764 - DNA, 20 bp, Artificial
  CRISPR gRNA sequence
aagtccaaagggatagcctt

SEQ ID NO: 815765 - DNA, 20 bp, Artificial
  CRISPR gRNA sequence
aaggttcattgttcatttgg

SEQ ID NO: 815766 - DNA, 20 bp, Artificial
  CRISPR gRNA sequence
aggttcattgttcatttggg

SEQ ID NO: 815767 - DNA, 20 bp, Artificial
  CRISPR gRNA sequence
attgttcatttgggttttag

SEQ ID NO: 815768 - DNA, 20 bp, Artificial
  CRISPR gRNA sequence
ttcatttgggttttaggaag

SEQ ID NO: 815769 - DNA, 20 bp, Artificial
  CRISPR gRNA sequence
atttgggttttaggaagact

SEQ ID NO: 815770 - DNA, 20 bp, Artificial
  CRISPR gRNA sequence
gggttttaggaagactcagt

SEQ ID NO: 815771 - DNA, 20 bp, Artificial
  CRISPR gRNA sequence
ggttttaggaagactcagta

SEQ ID NO: 815772 - DNA, 20 bp, Artificial
  CRISPR gRNA sequence
taggaagactcagtaaacca

SEQ ID NO: 815773 - DNA, 20 bp, Artificial
  CRISPR gRNA sequence
aggaagactcagtaaaccac

SEQ ID NO: 815774 - DNA, 20 bp, Artificial
  CRISPR gRNA sequence
ggaagactcagtaaaccaca

SEQ ID NO: 815775 - DNA, 20 bp, Artificial
  CRISPR gRNA sequence
agtaaaccacattaaggtat

SEQ ID NO: 815776 - DNA, 20 bp, Artificial
  CRISPR gRNA sequence
aggtatgaatgaccaacggc

SEQ ID NO: 815777 - DNA, 20 bp, Artificial
  CRISPR gRNA sequence
ctattgttgcttttcaaaaa

SEQ ID NO: 815778 - DNA, 20 bp, Artificial
  CRISPR gRNA sequence
ttgttgcttttcaaaaaaga

SEQ ID NO: 815779 - DNA, 20 bp, Artificial
  CRISPR gRNA sequence
ttgcttttcaaaaaagaaac

SEQ ID NO: 815780 - DNA, 20 bp, Artificial
  CRISPR gRNA sequence
cttttcaaaaaagaaactca

SEQ ID NO: 815781 - DNA, 20 bp, Artificial
  CRISPR gRNA sequence
ttcaaaaaagaaactcacag

SEQ ID NO: 815782 - DNA, 20 bp, Artificial
  CRISPR gRNA sequence
tcaaaaaagaaactcacaga

SEQ ID NO: 815783 - DNA, 20 bp, Artificial
  CRISPR gRNA sequence
caaaaaagaaactcacagaa

SEQ ID NO: 815784 - DNA, 20 bp, Artificial
  CRISPR gRNA sequence
aaaaaagaaactcacagaaa

SEQ ID NO: 815785 - DNA, 20 bp, Artificial
  CRISPR gRNA sequence
acagaaacaactaataatat

SEQ ID NO: 815786 - DNA, 20 bp, Artificial
  CRISPR gRNA sequence
ataatatgcagaatgtcttc

SEQ ID NO: 815787 - DNA, 20 bp, Artificial
  CRISPR gRNA sequence
caagacattatctttagagt

SEQ ID NO: 815788 - DNA, 20 bp, Artificial
  CRISPR gRNA sequence
aagacattatctttagagta

SEQ ID NO: 815789 - DNA, 20 bp, Artificial
  CRISPR gRNA sequence
tctttagagtaacggtgttc

SEQ ID NO: 815790 - DNA, 20 bp, Artificial
  CRISPR gRNA sequence
tagagtaacggtgttccctg

SEQ ID NO: 815791 - DNA, 20 bp, Artificial
  CRISPR gRNA sequence
agagtaacggtgttccctgg

SEQ ID NO: 815792 - DNA, 20 bp, Artificial
  CRISPR gRNA sequence
gagtaacggtgttccctggc

SEQ ID NO: 815793 - DNA, 20 bp, Artificial
  CRISPR gRNA sequence
cctggccattgtctccttac

SEQ ID NO: 815794 - DNA, 20 bp, Artificial
  CRISPR gRNA sequence
gccattgtctccttactctc

SEQ ID NO: 815795 - DNA, 20 bp, Artificial
  CRISPR gRNA sequence
tctccttactctccctgcca

SEQ ID NO: 815796 - DNA, 20 bp, Artificial
  CRISPR gRNA sequence
cttactctccctgccagaaa

SEQ ID NO: 815797 - DNA, 20 bp, Artificial
  CRISPR gRNA sequence
actctccctgccagaaagga

SEQ ID NO: 815798 - DNA, 20 bp, Artificial
  CRISPR gRNA sequence
ctctccctgccagaaaggaa

SEQ ID NO: 815799 - DNA, 20 bp, Artificial
  CRISPR gRNA sequence
tccctgccagaaaggaaggg

SEQ ID NO: 815800 - DNA, 20 bp, Artificial
  CRISPR gRNA sequence
cctgccagaaaggaagggga

SEQ ID NO: 815801 - DNA, 20 bp, Artificial
  CRISPR gRNA sequence
ccagaaaggaaggggacagc

SEQ ID NO: 815802 - DNA, 20 bp, Artificial
  CRISPR gRNA sequence
cttggcatctcacctttaag

SEQ ID NO: 815803 - DNA, 20 bp, Artificial
  CRISPR gRNA sequence
ggcatctcacctttaaggga

SEQ ID NO: 815804 - DNA, 20 bp, Artificial
  CRISPR gRNA sequence
gcatctcacctttaagggaa

SEQ ID NO: 815805 - DNA, 20 bp, Artificial
  CRISPR gRNA sequence
acctttaagggaactcaacc

SEQ ID NO: 815806 - DNA, 20 bp, Artificial
  CRISPR gRNA sequence
taagggaactcaacccctgc

SEQ ID NO: 815807 - DNA, 20 bp, Artificial
  CRISPR gRNA sequence
aagggaactcaacccctgcc

SEQ ID NO: 815808 - DNA, 20 bp, Artificial
  CRISPR gRNA sequence
agggaactcaacccctgccc

SEQ ID NO: 815809 - DNA, 20 bp, Artificial
  CRISPR gRNA sequence
aacccctgccctcttgtatc

SEQ ID NO: 815810 - DNA, 20 bp, Artificial
  CRISPR gRNA sequence
ccctcttgtatcagtttaga

SEQ ID NO: 815811 - DNA, 20 bp, Artificial
  CRISPR gRNA sequence
ttgtatcagtttagatttac

SEQ ID NO: 815812 - DNA, 20 bp, Artificial
  CRISPR gRNA sequence
gtatcagtttagatttacat

SEQ ID NO: 815813 - DNA, 20 bp, Artificial
  CRISPR gRNA sequence
tatcagtttagatttacatg

SEQ ID NO: 815814 - DNA, 20 bp, Artificial
  CRISPR gRNA sequence
agatttacatggtctgagtg

SEQ ID NO: 815815 - DNA, 20 bp, Artificial
  CRISPR gRNA sequence
gatttacatggtctgagtga

SEQ ID NO: 815816 - DNA, 20 bp, Artificial
  CRISPR gRNA sequence
acatggtctgagtgatcctg

SEQ ID NO: 815817 - DNA, 20 bp, Artificial
  CRISPR gRNA sequence
catggtctgagtgatcctgt

SEQ ID NO: 815818 - DNA, 20 bp, Artificial
  CRISPR gRNA sequence
agtgatcctgtcttcttgtc

SEQ ID NO: 815819 - DNA, 20 bp, Artificial
  CRISPR gRNA sequence
tcttcttgtcattaccctca

SEQ ID NO: 815820 - DNA, 20 bp, Artificial
  CRISPR gRNA sequence
cttgtcattaccctcactgg

SEQ ID NO: 815821 - DNA, 20 bp, Artificial
  CRISPR gRNA sequence
ttgtcattaccctcactgga

SEQ ID NO: 815822 - DNA, 20 bp, Artificial
  CRISPR gRNA sequence
gtcattaccctcactggata

SEQ ID NO: 815823 - DNA, 20 bp, Artificial
  CRISPR gRNA sequence
tcattaccctcactggatag

SEQ ID NO: 815824 - DNA, 20 bp, Artificial
  CRISPR gRNA sequence
ccctcactggatagtgggaa

SEQ ID NO: 815825 - DNA, 20 bp, Artificial
  CRISPR gRNA sequence
actggatagtgggaatagat

SEQ ID NO: 815826 - DNA, 20 bp, Artificial
  CRISPR gRNA sequence
gatagtgggaatagatggag

SEQ ID NO: 815827 - DNA, 20 bp, Artificial
  CRISPR gRNA sequence
tcagtcaccgtttctgtcag

SEQ ID NO: 815828 - DNA, 20 bp, Artificial
  CRISPR gRNA sequence
agtcaccgtttctgtcagat

SEQ ID NO: 815829 - DNA, 20 bp, Artificial
  CRISPR gRNA sequence
ctgtcagatagggacattgg

SEQ ID NO: 815830 - DNA, 20 bp, Artificial
  CRISPR gRNA sequence
tgtcagatagggacattggc

SEQ ID NO: 815831 - DNA, 20 bp, Artificial
  CRISPR gRNA sequence
tcagatagggacattggcat

SEQ ID NO: 815832 - DNA, 20 bp, Artificial
  CRISPR gRNA sequence
gcatgtataagccaccatgg

SEQ ID NO: 815833 - DNA, 20 bp, Artificial
  CRISPR gRNA sequence
tttttttttttgtggtgctt

SEQ ID NO: 815834 - DNA, 20 bp, Artificial
  CRISPR gRNA sequence
tttttttttgtggtgcttgg

SEQ ID NO: 815835 - DNA, 20 bp, Artificial
  CRISPR gRNA sequence
ttttttttgtggtgcttgga

SEQ ID NO: 815836 - DNA, 20 bp, Artificial
  CRISPR gRNA sequence
tttttttgtggtgcttggaa

SEQ ID NO: 815837 - DNA, 20 bp, Artificial
  CRISPR gRNA sequence
ttttttgtggtgcttggaat

SEQ ID NO: 815838 - DNA, 20 bp, Artificial
  CRISPR gRNA sequence
tttttgtggtgcttggaata

SEQ ID NO: 815839 - DNA, 20 bp, Artificial
  CRISPR gRNA sequence
ttttgtggtgcttggaatag

SEQ ID NO: 815840 - DNA, 20 bp, Artificial
  CRISPR gRNA sequence
tttgtggtgcttggaatagc

SEQ ID NO: 815841 - DNA, 20 bp, Artificial
  CRISPR gRNA sequence
ttgtggtgcttggaatagcc

SEQ ID NO: 815842 - DNA, 20 bp, Artificial
  CRISPR gRNA sequence
tgtggtgcttggaatagccc

SEQ ID NO: 815843 - DNA, 20 bp, Artificial
  CRISPR gRNA sequence
gtggtgcttggaatagccca

SEQ ID NO: 815844 - DNA, 20 bp, Artificial
  CRISPR gRNA sequence
tggtgcttggaatagcccag

SEQ ID NO: 815845 - DNA, 20 bp, Artificial
  CRISPR gRNA sequence
ggaatagcccagaaatcata

SEQ ID NO: 815846 - DNA, 20 bp, Artificial
  CRISPR gRNA sequence
gaatagcccagaaatcatac

SEQ ID NO: 815847 - DNA, 20 bp, Artificial
  CRISPR gRNA sequence
tcaaagaaagccctcagcct

SEQ ID NO: 815848 - DNA, 20 bp, Artificial
  CRISPR gRNA sequence
aaagaaagccctcagcctga

SEQ ID NO: 815849 - DNA, 20 bp, Artificial
  CRISPR gRNA sequence
agcctgagggccacattctc

SEQ ID NO: 815850 - DNA, 20 bp, Artificial
  CRISPR gRNA sequence
agggccacattctcattttt

SEQ ID NO: 815851 - DNA, 20 bp, Artificial
  CRISPR gRNA sequence
tcatttttggctttggctag

SEQ ID NO: 815852 - DNA, 20 bp, Artificial
  CRISPR gRNA sequence
atttttggctttggctagga

SEQ ID NO: 815853 - DNA, 20 bp, Artificial
  CRISPR gRNA sequence
ttggctttggctaggaacca

SEQ ID NO: 815854 - DNA, 20 bp, Artificial
  CRISPR gRNA sequence
tggctttggctaggaaccac

SEQ ID NO: 815855 - DNA, 20 bp, Artificial
  CRISPR gRNA sequence
ggctttggctaggaaccacc

SEQ ID NO: 815856 - DNA, 20 bp, Artificial
  CRISPR gRNA sequence
gctttggctaggaaccacca

SEQ ID NO: 815857 - DNA, 20 bp, Artificial
  CRISPR gRNA sequence
tggctaggaaccaccacctg

SEQ ID NO: 815858 - DNA, 20 bp, Artificial
  CRISPR gRNA sequence
ggctaggaaccaccacctgc

SEQ ID NO: 815859 - DNA, 20 bp, Artificial
  CRISPR gRNA sequence
gctaggaaccaccacctgct

SEQ ID NO: 815860 - DNA, 20 bp, Artificial
  CRISPR gRNA sequence
ggaaccaccacctgctcttc

SEQ ID NO: 815861 - DNA, 20 bp, Artificial
  CRISPR gRNA sequence
ctcttctttcttaagcctct

SEQ ID NO: 815862 - DNA, 20 bp, Artificial
  CRISPR gRNA sequence
ttctttcttaagcctctccc

SEQ ID NO: 815863 - DNA, 20 bp, Artificial
  CRISPR gRNA sequence
ctttcttaagcctctccctt

SEQ ID NO: 815864 - DNA, 20 bp, Artificial
  CRISPR gRNA sequence
tttcttaagcctctcccttt

SEQ ID NO: 815865 - DNA, 20 bp, Artificial
  CRISPR gRNA sequence
tcttaagcctctccctttgt

SEQ ID NO: 815866 - DNA, 20 bp, Artificial
  CRISPR gRNA sequence
cttaagcctctccctttgtc

SEQ ID NO: 815867 - DNA, 20 bp, Artificial
  CRISPR gRNA sequence
ttaagcctctccctttgtcc

SEQ ID NO: 815868 - DNA, 20 bp, Artificial
  CRISPR gRNA sequence
aagcctctccctttgtcctt

SEQ ID NO: 815869 - DNA, 20 bp, Artificial
  CRISPR gRNA sequence
agcctctccctttgtccttt

SEQ ID NO: 815870 - DNA, 20 bp, Artificial
  CRISPR gRNA sequence
tccctttgtcctttcttacc

SEQ ID NO: 815871 - DNA, 20 bp, Artificial
  CRISPR gRNA sequence
cctttgtcctttcttacctg

SEQ ID NO: 815872 - DNA, 20 bp, Artificial
  CRISPR gRNA sequence
tgtcctttcttacctgctat

SEQ ID NO: 815873 - DNA, 20 bp, Artificial
  CRISPR gRNA sequence
gtcctttcttacctgctatc

SEQ ID NO: 815874 - DNA, 20 bp, Artificial
  CRISPR gRNA sequence
tcctttcttacctgctatct

SEQ ID NO: 815875 - DNA, 20 bp, Artificial
  CRISPR gRNA sequence
tcttacctgctatctggtga

SEQ ID NO: 815876 - DNA, 20 bp, Artificial
  CRISPR gRNA sequence
cttacctgctatctggtgaa

SEQ ID NO: 815877 - DNA, 20 bp, Artificial
  CRISPR gRNA sequence
ttacctgctatctggtgaag

SEQ ID NO: 815878 - DNA, 20 bp, Artificial
  CRISPR gRNA sequence
acctgctatctggtgaagct

SEQ ID NO: 815879 - DNA, 20 bp, Artificial
  CRISPR gRNA sequence
cctgctatctggtgaagctg

SEQ ID NO: 815880 - DNA, 20 bp, Artificial
  CRISPR gRNA sequence
ctatctggtgaagctgcaat

SEQ ID NO: 815881 - DNA, 20 bp, Artificial
  CRISPR gRNA sequence
tctggtgaagctgcaattcc

SEQ ID NO: 815882 - DNA, 20 bp, Artificial
  CRISPR gRNA sequence
gtgaagctgcaattccaggc

SEQ ID NO: 815883 - DNA, 20 bp, Artificial
  CRISPR gRNA sequence
caattccaggctcaacatta

SEQ ID NO: 815884 - DNA, 20 bp, Artificial
  CRISPR gRNA sequence
caggctcaacattagcagga

SEQ ID NO: 815885 - DNA, 20 bp, Artificial
  CRISPR gRNA sequence
aacattagcaggaggaagat

SEQ ID NO: 815886 - DNA, 20 bp, Artificial
  CRISPR gRNA sequence
gcaggaggaagatcatgttc

SEQ ID NO: 815887 - DNA, 20 bp, Artificial
  CRISPR gRNA sequence
tgtatttgatctgaaataga

SEQ ID NO: 815888 - DNA, 20 bp, Artificial
  CRISPR gRNA sequence
tatttgatctgaaatagaca

SEQ ID NO: 815889 - DNA, 20 bp, Artificial
  CRISPR gRNA sequence
gatctgaaatagacaattga

SEQ ID NO: 815890 - DNA, 20 bp, Artificial
  CRISPR gRNA sequence
atctgaaatagacaattgaa

SEQ ID NO: 815891 - DNA, 20 bp, Artificial
  CRISPR gRNA sequence
aaatagacaattgaaagtct

SEQ ID NO: 815892 - DNA, 20 bp, Artificial
  CRISPR gRNA sequence
aaagtctcagggccttgtga

SEQ ID NO: 815893 - DNA, 20 bp, Artificial
  CRISPR gRNA sequence
agggccttgtgaaactttgc

SEQ ID NO: 815894 - DNA, 20 bp, Artificial
  CRISPR gRNA sequence
gtgaaactttgctgggtctt

SEQ ID NO: 815895 - DNA, 20 bp, Artificial
  CRISPR gRNA sequence
tgaaactttgctgggtcttt

SEQ ID NO: 815896 - DNA, 20 bp, Artificial
  CRISPR gRNA sequence
tgctgggtctttggttcttt

SEQ ID NO: 815897 - DNA, 20 bp, Artificial
  CRISPR gRNA sequence
gctgggtctttggttctttg

SEQ ID NO: 815898 - DNA, 20 bp, Artificial
  CRISPR gRNA sequence
ctgggtctttggttctttgt

SEQ ID NO: 815899 - DNA, 20 bp, Artificial
  CRISPR gRNA sequence
ggtctttggttctttgttca

SEQ ID NO: 815900 - DNA, 20 bp, Artificial
  CRISPR gRNA sequence
tggttctttgttcacttttg

SEQ ID NO: 815901 - DNA, 20 bp, Artificial
  CRISPR gRNA sequence
ggttctttgttcacttttga

SEQ ID NO: 815902 - DNA, 20 bp, Artificial
  CRISPR gRNA sequence
gttctttgttcacttttgaa

SEQ ID NO: 815903 - DNA, 20 bp, Artificial
  CRISPR gRNA sequence
tttgttcacttttgaaaaca

SEQ ID NO: 815904 - DNA, 20 bp, Artificial
  CRISPR gRNA sequence
tgttcacttttgaaaacagg

SEQ ID NO: 815905 - DNA, 20 bp, Artificial
  CRISPR gRNA sequence
gttcacttttgaaaacaggg

SEQ ID NO: 815906 - DNA, 20 bp, Artificial
  CRISPR gRNA sequence
ttcacttttgaaaacagggg

SEQ ID NO: 815907 - DNA, 20 bp, Artificial
  CRISPR gRNA sequence
acttttgaaaacaggggaat

SEQ ID NO: 815908 - DNA, 20 bp, Artificial
  CRISPR gRNA sequence
ttgaaaacaggggaataaca

SEQ ID NO: 815909 - DNA, 20 bp, Artificial
  CRISPR gRNA sequence
tgaaaacaggggaataacaa

SEQ ID NO: 815910 - DNA, 20 bp, Artificial
  CRISPR gRNA sequence
gaaaacaggggaataacaaa

SEQ ID NO: 815911 - DNA, 20 bp, Artificial
  CRISPR gRNA sequence
aaaacaggggaataacaaat

SEQ ID NO: 815912 - DNA, 20 bp, Artificial
  CRISPR gRNA sequence
ggggaaggtgacagaccatg

SEQ ID NO: 815913 - DNA, 20 bp, Artificial
  CRISPR gRNA sequence
gggaaggtgacagaccatgg

SEQ ID NO: 815914 - DNA, 20 bp, Artificial
  CRISPR gRNA sequence
ggaggagaagttataggttg

SEQ ID NO: 815915 - DNA, 20 bp, Artificial
  CRISPR gRNA sequence
taggttgatttcctggagaa

SEQ ID NO: 815916 - DNA, 20 bp, Artificial
  CRISPR gRNA sequence
atttcctggagaagagaaga

SEQ ID NO: 815917 - DNA, 20 bp, Artificial
  CRISPR gRNA sequence
cctggagaagagaagatata

SEQ ID NO: 815918 - DNA, 20 bp, Artificial
  CRISPR gRNA sequence
ctggagaagagaagatataa

SEQ ID NO: 815919 - DNA, 20 bp, Artificial
  CRISPR gRNA sequence
gagaagagaagatataaatt

SEQ ID NO: 815920 - DNA, 20 bp, Artificial
  CRISPR gRNA sequence
agagtaaacaagacactctt

SEQ ID NO: 815921 - DNA, 20 bp, Artificial
  CRISPR gRNA sequence
tttataaatccaaatgagaa

SEQ ID NO: 815922 - DNA, 20 bp, Artificial
  CRISPR gRNA sequence
tataaatccaaatgagaagt

SEQ ID NO: 815923 - DNA, 20 bp, Artificial
  CRISPR gRNA sequence
ataaatccaaatgagaagtt

SEQ ID NO: 815924 - DNA, 20 bp, Artificial
  CRISPR gRNA sequence
taaatccaaatgagaagttc

SEQ ID NO: 815925 - DNA, 20 bp, Artificial
  CRISPR gRNA sequence
ttcttccttttctaatggcc

SEQ ID NO: 815926 - DNA, 20 bp, Artificial
  CRISPR gRNA sequence
cttccttttctaatggccgt

SEQ ID NO: 815927 - DNA, 20 bp, Artificial
  CRISPR gRNA sequence
ttccttttctaatggccgtt

SEQ ID NO: 815928 - DNA, 20 bp, Artificial
  CRISPR gRNA sequence
ccttttctaatggccgtttc

SEQ ID NO: 815929 - DNA, 20 bp, Artificial
  CRISPR gRNA sequence
cttttctaatggccgtttct

SEQ ID NO: 815930 - DNA, 20 bp, Artificial
  CRISPR gRNA sequence
ttctaatggccgtttctgaa

SEQ ID NO: 815931 - DNA, 20 bp, Artificial
  CRISPR gRNA sequence
tctaatggccgtttctgaat

SEQ ID NO: 815932 - DNA, 20 bp, Artificial
  CRISPR gRNA sequence
ctaatggccgtttctgaata

SEQ ID NO: 815933 - DNA, 20 bp, Artificial
  CRISPR gRNA sequence
taatggccgtttctgaatat

SEQ ID NO: 815934 - DNA, 20 bp, Artificial
  CRISPR gRNA sequence
atggccgtttctgaatatga

SEQ ID NO: 815935 - DNA, 20 bp, Artificial
  CRISPR gRNA sequence
ctgaatatgaaccagtcctt

SEQ ID NO: 815936 - DNA, 20 bp, Artificial
  CRISPR gRNA sequence
tgaatatgaaccagtccttg

SEQ ID NO: 815937 - DNA, 20 bp, Artificial
  CRISPR gRNA sequence
aatatgaaccagtccttgtg

SEQ ID NO: 815938 - DNA, 20 bp, Artificial
  CRISPR gRNA sequence
gtgaaccacacatattggca

SEQ ID NO: 815939 - DNA, 20 bp, Artificial
  CRISPR gRNA sequence
tgaaccacacatattggcag

SEQ ID NO: 815940 - DNA, 20 bp, Artificial
  CRISPR gRNA sequence
gcagttacctgcacgtctca

SEQ ID NO: 815941 - DNA, 20 bp, Artificial
  CRISPR gRNA sequence
cctgcacgtctcatgaagct

SEQ ID NO: 815942 - DNA, 20 bp, Artificial
  CRISPR gRNA sequence
cacgtctcatgaagctttcc

SEQ ID NO: 815943 - DNA, 20 bp, Artificial
  CRISPR gRNA sequence
atgaagctttccatagcttt

SEQ ID NO: 815944 - DNA, 20 bp, Artificial
  CRISPR gRNA sequence
tccatagcttttttcaatag

SEQ ID NO: 815945 - DNA, 20 bp, Artificial
  CRISPR gRNA sequence
ccatagcttttttcaatagc

SEQ ID NO: 815946 - DNA, 20 bp, Artificial
  CRISPR gRNA sequence
catagcttttttcaatagct

SEQ ID NO: 815947 - DNA, 20 bp, Artificial
  CRISPR gRNA sequence
ttttcaatagctggcccttg

SEQ ID NO: 815948 - DNA, 20 bp, Artificial
  CRISPR gRNA sequence
tttcaatagctggcccttga

SEQ ID NO: 815949 - DNA, 20 bp, Artificial
  CRISPR gRNA sequence
ttcaatagctggcccttgaa

SEQ ID NO: 815950 - DNA, 20 bp, Artificial
  CRISPR gRNA sequence
tcaatagctggcccttgaac

SEQ ID NO: 815951 - DNA, 20 bp, Artificial
  CRISPR gRNA sequence
caatagctggcccttgaacc

SEQ ID NO: 815952 - DNA, 20 bp, Artificial
  CRISPR gRNA sequence
aatagctggcccttgaaccc

SEQ ID NO: 815953 - DNA, 20 bp, Artificial
  CRISPR gRNA sequence
gcccttgaaccccaactttg

SEQ ID NO: 815954 - DNA, 20 bp, Artificial
  CRISPR gRNA sequence
gaaccccaactttgtttgtc

SEQ ID NO: 815955 - DNA, 20 bp, Artificial
  CRISPR gRNA sequence
aaccccaactttgtttgtca

SEQ ID NO: 815956 - DNA, 20 bp, Artificial
  CRISPR gRNA sequence
tgtttgtcaaatgaataatg

SEQ ID NO: 815957 - DNA, 20 bp, Artificial
  CRISPR gRNA sequence
gtttgtcaaatgaataatgg

SEQ ID NO: 815958 - DNA, 20 bp, Artificial
  CRISPR gRNA sequence
tttgtcaaatgaataatgga

SEQ ID NO: 815959 - DNA, 20 bp, Artificial
  CRISPR gRNA sequence
gtcaaatgaataatggacac

SEQ ID NO: 815960 - DNA, 20 bp, Artificial
  CRISPR gRNA sequence
tcaaatgaataatggacacc

SEQ ID NO: 815961 - DNA, 20 bp, Artificial
  CRISPR gRNA sequence
ctttacctggactggatgtc

SEQ ID NO: 815962 - DNA, 20 bp, Artificial
  CRISPR gRNA sequence
tttacctggactggatgtct

SEQ ID NO: 815963 - DNA, 20 bp, Artificial
  CRISPR gRNA sequence
tacctggactggatgtctgg

SEQ ID NO: 815964 - DNA, 20 bp, Artificial
  CRISPR gRNA sequence
acctggactggatgtctggg

SEQ ID NO: 815965 - DNA, 20 bp, Artificial
  CRISPR gRNA sequence
cctggactggatgtctggga

SEQ ID NO: 815966 - DNA, 20 bp, Artificial
  CRISPR gRNA sequence
gactggatgtctgggagtct

SEQ ID NO: 815967 - DNA, 20 bp, Artificial
  CRISPR gRNA sequence
gatgtctgggagtctgacac

SEQ ID NO: 815968 - DNA, 20 bp, Artificial
  CRISPR gRNA sequence
ggagtctgacacttgaaaat

SEQ ID NO: 815969 - DNA, 20 bp, Artificial
  CRISPR gRNA sequence
acacttgaaaataagactcc

SEQ ID NO: 815970 - DNA, 20 bp, Artificial
  CRISPR gRNA sequence
gaaaataagactccatagaa

SEQ ID NO: 815971 - DNA, 20 bp, Artificial
  CRISPR gRNA sequence
aaaataagactccatagaac

SEQ ID NO: 815972 - DNA, 20 bp, Artificial
  CRISPR gRNA sequence
catagaacagagctacattc

SEQ ID NO: 815973 - DNA, 20 bp, Artificial
  CRISPR gRNA sequence
cattctcaataaatacttgc

SEQ ID NO: 815974 - DNA, 20 bp, Artificial
  CRISPR gRNA sequence
tcaataaatacttgctagtt

SEQ ID NO: 815975 - DNA, 20 bp, Artificial
  CRISPR gRNA sequence
aataaatacttgctagttga

SEQ ID NO: 815976 - DNA, 20 bp, Artificial
  CRISPR gRNA sequence
gctagttgactgagcaaagt

SEQ ID NO: 815977 - DNA, 20 bp, Artificial
  CRISPR gRNA sequence
ctagttgactgagcaaagta

SEQ ID NO: 815978 - DNA, 20 bp, Artificial
  CRISPR gRNA sequence
gttgactgagcaaagtagtc

SEQ ID NO: 815979 - DNA, 20 bp, Artificial
  CRISPR gRNA sequence
actgagcaaagtagtcaagt

SEQ ID NO: 815980 - DNA, 20 bp, Artificial
  CRISPR gRNA sequence
agcaaagtagtcaagtgctt

SEQ ID NO: 815981 - DNA, 20 bp, Artificial
  CRISPR gRNA sequence
ttgagtgctggaattgagtt

SEQ ID NO: 815982 - DNA, 20 bp, Artificial
  CRISPR gRNA sequence
tgagtgctggaattgagttt

SEQ ID NO: 815983 - DNA, 20 bp, Artificial
  CRISPR gRNA sequence
gagtgctggaattgagtttg

SEQ ID NO: 815984 - DNA, 20 bp, Artificial
  CRISPR gRNA sequence
agtgctggaattgagtttgc

SEQ ID NO: 815985 - DNA, 20 bp, Artificial
  CRISPR gRNA sequence
gaattgagtttgcccctctc

SEQ ID NO: 815986 - DNA, 20 bp, Artificial
  CRISPR gRNA sequence
agtttgcccctctcttgaac

SEQ ID NO: 815987 - DNA, 20 bp, Artificial
  CRISPR gRNA sequence
gcccctctcttgaactacct

SEQ ID NO: 815988 - DNA, 20 bp, Artificial
  CRISPR gRNA sequence
cccctctcttgaactacctc

SEQ ID NO: 815989 - DNA, 20 bp, Artificial
  CRISPR gRNA sequence
tcttgaactacctcttacta

SEQ ID NO: 815990 - DNA, 20 bp, Artificial
  CRISPR gRNA sequence
ttgaactacctcttactaag

SEQ ID NO: 815991 - DNA, 20 bp, Artificial
  CRISPR gRNA sequence
gaactacctcttactaagag

SEQ ID NO: 815992 - DNA, 20 bp, Artificial
  CRISPR gRNA sequence
aactacctcttactaagagg

SEQ ID NO: 815993 - DNA, 20 bp, Artificial
  CRISPR gRNA sequence
cctcttactaagaggtttag

SEQ ID NO: 815994 - DNA, 20 bp, Artificial
  CRISPR gRNA sequence
ttactaagaggtttagacag

SEQ ID NO: 815995 - DNA, 20 bp, Artificial
  CRISPR gRNA sequence
actaagaggtttagacaggg

SEQ ID NO: 815996 - DNA, 20 bp, Artificial
  CRISPR gRNA sequence
ctaagaggtttagacaggga

SEQ ID NO: 815997 - DNA, 20 bp, Artificial
  CRISPR gRNA sequence
agaggtttagacagggagag

SEQ ID NO: 815998 - DNA, 20 bp, Artificial
  CRISPR gRNA sequence
agacagggagagtagggaac

SEQ ID NO: 815999 - DNA, 20 bp, Artificial
  CRISPR gRNA sequence
gacagggagagtagggaact

SEQ ID NO: 816000 - DNA, 20 bp, Artificial
  CRISPR gRNA sequence
gctctgatgagggtgggggc

SEQ ID NO: 816001 - DNA, 20 bp, Artificial
  CRISPR gRNA sequence
tgatgagggtgggggctgcg

SEQ ID NO: 816002 - DNA, 20 bp, Artificial
  CRISPR gRNA sequence
atgagggtgggggctgcgaa

SEQ ID NO: 816003 - DNA, 20 bp, Artificial
  CRISPR gRNA sequence
cgaatgccccaccttggtcc

SEQ ID NO: 816004 - DNA, 20 bp, Artificial
  CRISPR gRNA sequence
ggtcctgctgtacctcccat

SEQ ID NO: 816005 - DNA, 20 bp, Artificial
  CRISPR gRNA sequence
gtcctgctgtacctcccatg

SEQ ID NO: 816006 - DNA, 20 bp, Artificial
  CRISPR gRNA sequence
ctgtacctcccatgctttct

SEQ ID NO: 816007 - DNA, 20 bp, Artificial
  CRISPR gRNA sequence
tacctcccatgctttctcct

SEQ ID NO: 816008 - DNA, 20 bp, Artificial
  CRISPR gRNA sequence
ccatgctttctcctttactc

SEQ ID NO: 816009 - DNA, 20 bp, Artificial
  CRISPR gRNA sequence
tctcctttactctgaagctt

SEQ ID NO: 816010 - DNA, 20 bp, Artificial
  CRISPR gRNA sequence
ctcctttactctgaagcttt

SEQ ID NO: 816011 - DNA, 20 bp, Artificial
  CRISPR gRNA sequence
tcctttactctgaagctttc

SEQ ID NO: 816012 - DNA, 20 bp, Artificial
  CRISPR gRNA sequence
ctttactctgaagctttctt

SEQ ID NO: 816013 - DNA, 20 bp, Artificial
  CRISPR gRNA sequence
tactctgaagctttctttat

SEQ ID NO: 816014 - DNA, 20 bp, Artificial
  CRISPR gRNA sequence
actctgaagctttctttatc

SEQ ID NO: 816015 - DNA, 20 bp, Artificial
  CRISPR gRNA sequence
ctctgaagctttctttatcc

SEQ ID NO: 816016 - DNA, 20 bp, Artificial
  CRISPR gRNA sequence
tgaagctttctttatccatg

SEQ ID NO: 816017 - DNA, 20 bp, Artificial
  CRISPR gRNA sequence
aagctttctttatccatgga

SEQ ID NO: 816018 - DNA, 20 bp, Artificial
  CRISPR gRNA sequence
tctttatccatggacttctt

SEQ ID NO: 816019 - DNA, 20 bp, Artificial
  CRISPR gRNA sequence
ctttatccatggacttctta

SEQ ID NO: 816020 - DNA, 20 bp, Artificial
  CRISPR gRNA sequence
tttatccatggacttcttat

SEQ ID NO: 816021 - DNA, 20 bp, Artificial
  CRISPR gRNA sequence
tatccatggacttcttatgg

SEQ ID NO: 816022 - DNA, 20 bp, Artificial
  CRISPR gRNA sequence
atccatggacttcttatggt

SEQ ID NO: 816023 - DNA, 20 bp, Artificial
  CRISPR gRNA sequence
tccatggacttcttatggtt

SEQ ID NO: 816024 - DNA, 20 bp, Artificial
  CRISPR gRNA sequence
cttatggttgaggaaaggga

SEQ ID NO: 816025 - DNA, 20 bp, Artificial
  CRISPR gRNA sequence
ttatggttgaggaaagggac

SEQ ID NO: 816026 - DNA, 20 bp, Artificial
  CRISPR gRNA sequence
atggttgaggaaagggacag

SEQ ID NO: 816027 - DNA, 20 bp, Artificial
  CRISPR gRNA sequence
tggttgaggaaagggacaga

SEQ ID NO: 816028 - DNA, 20 bp, Artificial
  CRISPR gRNA sequence
aggaaagggacagagcacac

SEQ ID NO: 816029 - DNA, 20 bp, Artificial
  CRISPR gRNA sequence
atctgataatggtctgaaac

SEQ ID NO: 816030 - DNA, 20 bp, Artificial
  CRISPR gRNA sequence
ataatggtctgaaactgagg

SEQ ID NO: 816031 - DNA, 20 bp, Artificial
  CRISPR gRNA sequence
aaactgaggaggctttccaa

SEQ ID NO: 816032 - DNA, 20 bp, Artificial
  CRISPR gRNA sequence
aggaggctttccaactttta

SEQ ID NO: 816033 - DNA, 20 bp, Artificial
  CRISPR gRNA sequence
tccaacttttatcagccatg

SEQ ID NO: 816034 - DNA, 20 bp, Artificial
  CRISPR gRNA sequence
ccaacttttatcagccatgg

SEQ ID NO: 816035 - DNA, 20 bp, Artificial
  CRISPR gRNA sequence
caacttttatcagccatgga

SEQ ID NO: 816036 - DNA, 20 bp, Artificial
  CRISPR gRNA sequence
ttatcagccatggaatcatt

SEQ ID NO: 816037 - DNA, 20 bp, Artificial
  CRISPR gRNA sequence
tatcagccatggaatcattt

SEQ ID NO: 816038 - DNA, 20 bp, Artificial
  CRISPR gRNA sequence
atcagccatggaatcatttc

SEQ ID NO: 816039 - DNA, 20 bp, Artificial
  CRISPR gRNA sequence
tcagccatggaatcatttct

SEQ ID NO: 816040 - DNA, 20 bp, Artificial
  CRISPR gRNA sequence
cttcaggggaaatctgttgg

SEQ ID NO: 816041 - DNA, 20 bp, Artificial
  CRISPR gRNA sequence
ttcaggggaaatctgttgga

SEQ ID NO: 816042 - DNA, 20 bp, Artificial
  CRISPR gRNA sequence
caggggaaatctgttggagc

SEQ ID NO: 816043 - DNA, 20 bp, Artificial
  CRISPR gRNA sequence
aggggaaatctgttggagcc

SEQ ID NO: 816044 - DNA, 20 bp, Artificial
  CRISPR gRNA sequence
ttggagccatacatctaaat

SEQ ID NO: 816045 - DNA, 20 bp, Artificial
  CRISPR gRNA sequence
gagccatacatctaaatcag

SEQ ID NO: 816046 - DNA, 20 bp, Artificial
  CRISPR gRNA sequence
aatcaggcaacagcagagct

SEQ ID NO: 816047 - DNA, 20 bp, Artificial
  CRISPR gRNA sequence
ctctgagtgtgatgaaaagc

SEQ ID NO: 816048 - DNA, 20 bp, Artificial
  CRISPR gRNA sequence
tgagtgtgatgaaaagcagt

SEQ ID NO: 816049 - DNA, 20 bp, Artificial
  CRISPR gRNA sequence
agtgtgatgaaaagcagtgg

SEQ ID NO: 816050 - DNA, 20 bp, Artificial
  CRISPR gRNA sequence
gggtcaggagaatgatagaa

SEQ ID NO: 816051 - DNA, 20 bp, Artificial
  CRISPR gRNA sequence
ggtcaggagaatgatagaac

SEQ ID NO: 816052 - DNA, 20 bp, Artificial
  CRISPR gRNA sequence
atttacatcattaagagaca

SEQ ID NO: 816053 - DNA, 20 bp, Artificial
  CRISPR gRNA sequence
acatcattaagagacaacta

SEQ ID NO: 816054 - DNA, 20 bp, Artificial
  CRISPR gRNA sequence
catcattaagagacaactaa

SEQ ID NO: 816055 - DNA, 20 bp, Artificial
  CRISPR gRNA sequence
agagacaactaagctttggt

SEQ ID NO: 816056 - DNA, 20 bp, Artificial
  CRISPR gRNA sequence
agctttggtgtaggcaatag

SEQ ID NO: 816057 - DNA, 20 bp, Artificial
  CRISPR gRNA sequence
tggtgtaggcaatagactat

SEQ ID NO: 816058 - DNA, 20 bp, Artificial
  CRISPR gRNA sequence
ggtgtaggcaatagactatt

SEQ ID NO: 816059 - DNA, 20 bp, Artificial
  CRISPR gRNA sequence
gtgtaggcaatagactattg

SEQ ID NO: 816060 - DNA, 20 bp, Artificial
  CRISPR gRNA sequence
ttgctgagagggagaggttg

SEQ ID NO: 816061 - DNA, 20 bp, Artificial
  CRISPR gRNA sequence
ctgagagggagaggttgctg

SEQ ID NO: 816062 - DNA, 20 bp, Artificial
  CRISPR gRNA sequence
agagggagaggttgctggca

SEQ ID NO: 816063 - DNA, 20 bp, Artificial
  CRISPR gRNA sequence
ctggcaagattacaagcagt

SEQ ID NO: 816064 - DNA, 20 bp, Artificial
  CRISPR gRNA sequence
gcaagattacaagcagtgag

SEQ ID NO: 816065 - DNA, 20 bp, Artificial
  CRISPR gRNA sequence
caagcagtgagatcggttag

SEQ ID NO: 816066 - DNA, 20 bp, Artificial
  CRISPR gRNA sequence
ggaatgtgtttgcagaaatg

SEQ ID NO: 816067 - DNA, 20 bp, Artificial
  CRISPR gRNA sequence
gcagaaatgctgatagctta

SEQ ID NO: 816068 - DNA, 20 bp, Artificial
  CRISPR gRNA sequence
cagaaatgctgatagcttag

SEQ ID NO: 816069 - DNA, 20 bp, Artificial
  CRISPR gRNA sequence
atagcttagagtagaggggc

SEQ ID NO: 816070 - DNA, 20 bp, Artificial
  CRISPR gRNA sequence
agagtagaggggctagtagg

SEQ ID NO: 816071 - DNA, 20 bp, Artificial
  CRISPR gRNA sequence
gagtagaggggctagtaggg

SEQ ID NO: 816072 - DNA, 20 bp, Artificial
  CRISPR gRNA sequence
gtaggggtgagaagtggtct

SEQ ID NO: 816073 - DNA, 20 bp, Artificial
  CRISPR gRNA sequence
ttggcgagtttatatatttt

SEQ ID NO: 816074 - DNA, 20 bp, Artificial
  CRISPR gRNA sequence
gcgagtttatatattttttc

SEQ ID NO: 816075 - DNA, 20 bp, Artificial
  CRISPR gRNA sequence
atatattttttctttgtttt

SEQ ID NO: 816076 - DNA, 20 bp, Artificial
  CRISPR gRNA sequence
tatattttttctttgtttta

SEQ ID NO: 816077 - DNA, 20 bp, Artificial
  CRISPR gRNA sequence
tttctttgttttaaaatttt

SEQ ID NO: 816078 - DNA, 20 bp, Artificial
  CRISPR gRNA sequence
ttctttgttttaaaatttta

SEQ ID NO: 816079 - DNA, 20 bp, Artificial
  CRISPR gRNA sequence
tctttgttttaaaattttat

SEQ ID NO: 816080 - DNA, 20 bp, Artificial
  CRISPR gRNA sequence
ctttgttttaaaattttatt

SEQ ID NO: 816081 - DNA, 20 bp, Artificial
  CRISPR gRNA sequence
tttgttttaaaattttattt

SEQ ID NO: 816082 - DNA, 20 bp, Artificial
  CRISPR gRNA sequence
tgttttaaaattttatttta

SEQ ID NO: 816083 - DNA, 20 bp, Artificial
  CRISPR gRNA sequence
gttttaaaattttattttaa

SEQ ID NO: 816084 - DNA, 20 bp, Artificial
  CRISPR gRNA sequence
ttttaaaattttattttaaa

SEQ ID NO: 816085 - DNA, 20 bp, Artificial
  CRISPR gRNA sequence
taaaattttattttaaaaat

SEQ ID NO: 816086 - DNA, 20 bp, Artificial
  CRISPR gRNA sequence
aaaattttattttaaaaatt

SEQ ID NO: 816087 - DNA, 20 bp, Artificial
  CRISPR gRNA sequence
aaattttattttaaaaattt

SEQ ID NO: 816088 - DNA, 20 bp, Artificial
  CRISPR gRNA sequence
tattttaaaaatttcaacag

SEQ ID NO: 816089 - DNA, 20 bp, Artificial
  CRISPR gRNA sequence
attttaaaaatttcaacagc

SEQ ID NO: 816090 - DNA, 20 bp, Artificial
  CRISPR gRNA sequence
ttttaaaaatttcaacagct

SEQ ID NO: 816091 - DNA, 20 bp, Artificial
  CRISPR gRNA sequence
taaaaatttcaacagcttta

SEQ ID NO: 816092 - DNA, 20 bp, Artificial
  CRISPR gRNA sequence
aaaaatttcaacagctttat

SEQ ID NO: 816093 - DNA, 20 bp, Artificial
  CRISPR gRNA sequence
aaaatttcaacagctttatt

SEQ ID NO: 816094 - DNA, 20 bp, Artificial
  CRISPR gRNA sequence
caacagctttattaaagtat

SEQ ID NO: 816095 - DNA, 20 bp, Artificial
  CRISPR gRNA sequence
aacagctttattaaagtata

SEQ ID NO: 816096 - DNA, 20 bp, Artificial
  CRISPR gRNA sequence
tattaaagtataattgatat

SEQ ID NO: 816097 - DNA, 20 bp, Artificial
  CRISPR gRNA sequence
attaaagtataattgatata

SEQ ID NO: 816098 - DNA, 20 bp, Artificial
  CRISPR gRNA sequence
ttaaagtataattgatatac

SEQ ID NO: 816099 - DNA, 20 bp, Artificial
  CRISPR gRNA sequence
aagtataattgatatacgaa

SEQ ID NO: 816100 - DNA, 20 bp, Artificial
  CRISPR gRNA sequence
atatacgaaagagggttata

SEQ ID NO: 816101 - DNA, 20 bp, Artificial
  CRISPR gRNA sequence
tatgtgtctaagtgtgtata

SEQ ID NO: 816102 - DNA, 20 bp, Artificial
  CRISPR gRNA sequence
agtgtgtatatatatttaaa

SEQ ID NO: 816103 - DNA, 20 bp, Artificial
  CRISPR gRNA sequence
aaaacacaaactttttttaa

SEQ ID NO: 816104 - DNA, 20 bp, Artificial
  CRISPR gRNA sequence
aaacacaaactttttttaag

SEQ ID NO: 816105 - DNA, 20 bp, Artificial
  CRISPR gRNA sequence
tttttaagtgcacgactctg

SEQ ID NO: 816106 - DNA, 20 bp, Artificial
  CRISPR gRNA sequence
ttttaagtgcacgactctgt

SEQ ID NO: 816107 - DNA, 20 bp, Artificial
  CRISPR gRNA sequence
tttaagtgcacgactctgtg

SEQ ID NO: 816108 - DNA, 20 bp, Artificial
  CRISPR gRNA sequence
ttaagtgcacgactctgtgg

SEQ ID NO: 816109 - DNA, 20 bp, Artificial
  CRISPR gRNA sequence
taagtgcacgactctgtggt

SEQ ID NO: 816110 - DNA, 20 bp, Artificial
  CRISPR gRNA sequence
aagtgcacgactctgtggtt

SEQ ID NO: 816111 - DNA, 20 bp, Artificial
  CRISPR gRNA sequence
agtgcacgactctgtggttt

SEQ ID NO: 816112 - DNA, 20 bp, Artificial
  CRISPR gRNA sequence
tgtggtttttagtatgttca

SEQ ID NO: 816113 - DNA, 20 bp, Artificial
  CRISPR gRNA sequence
tggtttttagtatgttcacg

SEQ ID NO: 816114 - DNA, 20 bp, Artificial
  CRISPR gRNA sequence
ttagtatgttcacggagttg

SEQ ID NO: 816115 - DNA, 20 bp, Artificial
  CRISPR gRNA sequence
tagtatgttcacggagttgt

SEQ ID NO: 816116 - DNA, 20 bp, Artificial
  CRISPR gRNA sequence
agtatgttcacggagttgtg

SEQ ID NO: 816117 - DNA, 20 bp, Artificial
  CRISPR gRNA sequence
gtatgttcacggagttgtgc

SEQ ID NO: 816118 - DNA, 20 bp, Artificial
  CRISPR gRNA sequence
acggagttgtgcaacaaaca

SEQ ID NO: 816119 - DNA, 20 bp, Artificial
  CRISPR gRNA sequence
tgcaacaaacactattatcc

SEQ ID NO: 816120 - DNA, 20 bp, Artificial
  CRISPR gRNA sequence
ttatccaattttagaacatt

SEQ ID NO: 816121 - DNA, 20 bp, Artificial
  CRISPR gRNA sequence
tccaattttagaacattttc

SEQ ID NO: 816122 - DNA, 20 bp, Artificial
  CRISPR gRNA sequence
tagaacattttcattaccct

SEQ ID NO: 816123 - DNA, 20 bp, Artificial
  CRISPR gRNA sequence
agaacattttcattaccctg

SEQ ID NO: 816124 - DNA, 20 bp, Artificial
  CRISPR gRNA sequence
gaacattttcattaccctga

SEQ ID NO: 816125 - DNA, 20 bp, Artificial
  CRISPR gRNA sequence
tcattaccctgaaaaggaac

SEQ ID NO: 816126 - DNA, 20 bp, Artificial
  CRISPR gRNA sequence
cattaccctgaaaaggaacc

SEQ ID NO: 816127 - DNA, 20 bp, Artificial
  CRISPR gRNA sequence
attaccctgaaaaggaaccc

SEQ ID NO: 816128 - DNA, 20 bp, Artificial
  CRISPR gRNA sequence
ccctgaaaaggaacccctta

SEQ ID NO: 816129 - DNA, 20 bp, Artificial
  CRISPR gRNA sequence
aaaaggaaccccttacccat

SEQ ID NO: 816130 - DNA, 20 bp, Artificial
  CRISPR gRNA sequence
acccattagcagaaacttcc

SEQ ID NO: 816131 - DNA, 20 bp, Artificial
  CRISPR gRNA sequence
cccattagcagaaacttcct

SEQ ID NO: 816132 - DNA, 20 bp, Artificial
  CRISPR gRNA sequence
gcagaaacttcctatttccc

SEQ ID NO: 816133 - DNA, 20 bp, Artificial
  CRISPR gRNA sequence
cctatttccccttccctttc

SEQ ID NO: 816134 - DNA, 20 bp, Artificial
  CRISPR gRNA sequence
ctatttccccttccctttcc

SEQ ID NO: 816135 - DNA, 20 bp, Artificial
  CRISPR gRNA sequence
tttccccttccctttcccta

SEQ ID NO: 816136 - DNA, 20 bp, Artificial
  CRISPR gRNA sequence
ccccttccctttccctatgg

SEQ ID NO: 816137 - DNA, 20 bp, Artificial
  CRISPR gRNA sequence
cccttccctttccctatggc

SEQ ID NO: 816138 - DNA, 20 bp, Artificial
  CRISPR gRNA sequence
ccctttccctatggcccttg

SEQ ID NO: 816139 - DNA, 20 bp, Artificial
  CRISPR gRNA sequence
cctttccctatggcccttgg

SEQ ID NO: 816140 - DNA, 20 bp, Artificial
  CRISPR gRNA sequence
tccctatggcccttggcaac

SEQ ID NO: 816141 - DNA, 20 bp, Artificial
  CRISPR gRNA sequence
ccctatggcccttggcaacc

SEQ ID NO: 816142 - DNA, 20 bp, Artificial
  CRISPR gRNA sequence
cctatggcccttggcaacca

SEQ ID NO: 816143 - DNA, 20 bp, Artificial
  CRISPR gRNA sequence
tggcccttggcaaccactaa

SEQ ID NO: 816144 - DNA, 20 bp, Artificial
  CRISPR gRNA sequence
ggcaaccactaatctagttt

SEQ ID NO: 816145 - DNA, 20 bp, Artificial
  CRISPR gRNA sequence
gcaaccactaatctagtttc

SEQ ID NO: 816146 - DNA, 20 bp, Artificial
  CRISPR gRNA sequence
atctagtttctgtctctatc

SEQ ID NO: 816147 - DNA, 20 bp, Artificial
  CRISPR gRNA sequence
gtttctgtctctatcaattg

SEQ ID NO: 816148 - DNA, 20 bp, Artificial
  CRISPR gRNA sequence
ctgtctctatcaattgctta

SEQ ID NO: 816149 - DNA, 20 bp, Artificial
  CRISPR gRNA sequence
tgtctctatcaattgcttat

SEQ ID NO: 816150 - DNA, 20 bp, Artificial
  CRISPR gRNA sequence
tctctatcaattgcttattc

SEQ ID NO: 816151 - DNA, 20 bp, Artificial
  CRISPR gRNA sequence
tatcaattgcttattctgga

SEQ ID NO: 816152 - DNA, 20 bp, Artificial
  CRISPR gRNA sequence
tcaattgcttattctggata

SEQ ID NO: 816153 - DNA, 20 bp, Artificial
  CRISPR gRNA sequence
cttattctggatatttcata

SEQ ID NO: 816154 - DNA, 20 bp, Artificial
  CRISPR gRNA sequence
attctggatatttcataaaa

SEQ ID NO: 816155 - DNA, 20 bp, Artificial
  CRISPR gRNA sequence
ttctggatatttcataaaaa

SEQ ID NO: 816156 - DNA, 20 bp, Artificial
  CRISPR gRNA sequence
tggatatttcataaaaatgg

SEQ ID NO: 816157 - DNA, 20 bp, Artificial
  CRISPR gRNA sequence
gatatttcataaaaatggaa

SEQ ID NO: 816158 - DNA, 20 bp, Artificial
  CRISPR gRNA sequence
cataaaaatggaatcaagca

SEQ ID NO: 816159 - DNA, 20 bp, Artificial
  CRISPR gRNA sequence
ataaaaatggaatcaagcaa

SEQ ID NO: 816160 - DNA, 20 bp, Artificial
  CRISPR gRNA sequence
ttgtggctggcttttttcac

SEQ ID NO: 816161 - DNA, 20 bp, Artificial
  CRISPR gRNA sequence
tgtggctggcttttttcacc

SEQ ID NO: 816162 - DNA, 20 bp, Artificial
  CRISPR gRNA sequence
gtggctggcttttttcaccg

SEQ ID NO: 816163 - DNA, 20 bp, Artificial
  CRISPR gRNA sequence
tggctggcttttttcaccga

SEQ ID NO: 816164 - DNA, 20 bp, Artificial
  CRISPR gRNA sequence
gcttttttcaccgaacataa

SEQ ID NO: 816165 - DNA, 20 bp, Artificial
  CRISPR gRNA sequence
ttttcaccgaacataatgtt

SEQ ID NO: 816166 - DNA, 20 bp, Artificial
  CRISPR gRNA sequence
tttcaccgaacataatgttg

SEQ ID NO: 816167 - DNA, 20 bp, Artificial
  CRISPR gRNA sequence
ttcaccgaacataatgttgt

SEQ ID NO: 816168 - DNA, 20 bp, Artificial
  CRISPR gRNA sequence
tcaccgaacataatgttgtc

SEQ ID NO: 816169 - DNA, 20 bp, Artificial
  CRISPR gRNA sequence
caccgaacataatgttgtca

SEQ ID NO: 816170 - DNA, 20 bp, Artificial
  CRISPR gRNA sequence
accgaacataatgttgtcaa

SEQ ID NO: 816171 - DNA, 20 bp, Artificial
  CRISPR gRNA sequence
tcaaggttcatctgtattgt

SEQ ID NO: 816172 - DNA, 20 bp, Artificial
  CRISPR gRNA sequence
atctgtattgtagcatatat

SEQ ID NO: 816173 - DNA, 20 bp, Artificial
  CRISPR gRNA sequence
tattgtagcatatatcagca

SEQ ID NO: 816174 - DNA, 20 bp, Artificial
  CRISPR gRNA sequence
tagcatatatcagcactgcg

SEQ ID NO: 816175 - DNA, 20 bp, Artificial
  CRISPR gRNA sequence
cgttcctttttgtgactaaa

SEQ ID NO: 816176 - DNA, 20 bp, Artificial
  CRISPR gRNA sequence
ctttttgtgactaaataata

SEQ ID NO: 816177 - DNA, 20 bp, Artificial
  CRISPR gRNA sequence
tttgtgactaaataatattc

SEQ ID NO: 816178 - DNA, 20 bp, Artificial
  CRISPR gRNA sequence
ttgtgactaaataatattcc

SEQ ID NO: 816179 - DNA, 20 bp, Artificial
  CRISPR gRNA sequence
tgtgactaaataatattcca

SEQ ID NO: 816180 - DNA, 20 bp, Artificial
  CRISPR gRNA sequence
gtgactaaataatattccat

SEQ ID NO: 816181 - DNA, 20 bp, Artificial
  CRISPR gRNA sequence
tgactaaataatattccatt

SEQ ID NO: 816182 - DNA, 20 bp, Artificial
  CRISPR gRNA sequence
aataatattccattgtatga

SEQ ID NO: 816183 - DNA, 20 bp, Artificial
  CRISPR gRNA sequence
cattgtatgatataccacat

SEQ ID NO: 816184 - DNA, 20 bp, Artificial
  CRISPR gRNA sequence
tatgatataccacattttgc

SEQ ID NO: 816185 - DNA, 20 bp, Artificial
  CRISPR gRNA sequence
tgcttacccattcatcagtt

SEQ ID NO: 816186 - DNA, 20 bp, Artificial
  CRISPR gRNA sequence
gcttacccattcatcagttg

SEQ ID NO: 816187 - DNA, 20 bp, Artificial
  CRISPR gRNA sequence
cttacccattcatcagttga

SEQ ID NO: 816188 - DNA, 20 bp, Artificial
  CRISPR gRNA sequence
acccattcatcagttgatgg

SEQ ID NO: 816189 - DNA, 20 bp, Artificial
  CRISPR gRNA sequence
cccattcatcagttgatggt

SEQ ID NO: 816190 - DNA, 20 bp, Artificial
  CRISPR gRNA sequence
atcagttgatggtcatttgg

SEQ ID NO: 816191 - DNA, 20 bp, Artificial
  CRISPR gRNA sequence
atggtcatttggattgtttc

SEQ ID NO: 816192 - DNA, 20 bp, Artificial
  CRISPR gRNA sequence
ggattgtttctgcttgttgg

SEQ ID NO: 816193 - DNA, 20 bp, Artificial
  CRISPR gRNA sequence
gattgtttctgcttgttggc

SEQ ID NO: 816194 - DNA, 20 bp, Artificial
  CRISPR gRNA sequence
tttctgcttgttggctatta

SEQ ID NO: 816195 - DNA, 20 bp, Artificial
  CRISPR gRNA sequence
ctgcttgttggctattatga

SEQ ID NO: 816196 - DNA, 20 bp, Artificial
  CRISPR gRNA sequence
tgcttgttggctattatgaa

SEQ ID NO: 816197 - DNA, 20 bp, Artificial
  CRISPR gRNA sequence
cttgttggctattatgaata

SEQ ID NO: 816198 - DNA, 20 bp, Artificial
  CRISPR gRNA sequence
gttggctattatgaataaag

SEQ ID NO: 816199 - DNA, 20 bp, Artificial
  CRISPR gRNA sequence
ttggctattatgaataaagt

SEQ ID NO: 816200 - DNA, 20 bp, Artificial
  CRISPR gRNA sequence
gctattatgaataaagttcc

SEQ ID NO: 816201 - DNA, 20 bp, Artificial
  CRISPR gRNA sequence
ttatgaataaagttcctatg

SEQ ID NO: 816202 - DNA, 20 bp, Artificial
  CRISPR gRNA sequence
tgaataaagttcctatgaaa

SEQ ID NO: 816203 - DNA, 20 bp, Artificial
  CRISPR gRNA sequence
ctatgaaaactcatatacaa

SEQ ID NO: 816204 - DNA, 20 bp, Artificial
  CRISPR gRNA sequence
tgaaaactcatatacaagtc

SEQ ID NO: 816205 - DNA, 20 bp, Artificial
  CRISPR gRNA sequence
atatacaagtctttgtctat

SEQ ID NO: 816206 - DNA, 20 bp, Artificial
  CRISPR gRNA sequence
tgtctatgtatacttttaat

SEQ ID NO: 816207 - DNA, 20 bp, Artificial
  CRISPR gRNA sequence
gtctatgtatacttttaatt

SEQ ID NO: 816208 - DNA, 20 bp, Artificial
  CRISPR gRNA sequence
tctatgtatacttttaatta

SEQ ID NO: 816209 - DNA, 20 bp, Artificial
  CRISPR gRNA sequence
tgtatacttttaattatctt

SEQ ID NO: 816210 - DNA, 20 bp, Artificial
  CRISPR gRNA sequence
ttaattatcttgggtacata

SEQ ID NO: 816211 - DNA, 20 bp, Artificial
  CRISPR gRNA sequence
taattatcttgggtacatat

SEQ ID NO: 816212 - DNA, 20 bp, Artificial
  CRISPR gRNA sequence
aattatcttgggtacatatg

SEQ ID NO: 816213 - DNA, 20 bp, Artificial
  CRISPR gRNA sequence
attatcttgggtacatatgt

SEQ ID NO: 816214 - DNA, 20 bp, Artificial
  CRISPR gRNA sequence
tcttgggtacatatgtagga

SEQ ID NO: 816215 - DNA, 20 bp, Artificial
  CRISPR gRNA sequence
gggtacatatgtaggagtag

SEQ ID NO: 816216 - DNA, 20 bp, Artificial
  CRISPR gRNA sequence
ggtacatatgtaggagtaga

SEQ ID NO: 816217 - DNA, 20 bp, Artificial
  CRISPR gRNA sequence
ctgaattaaatggtaactct

SEQ ID NO: 816218 - DNA, 20 bp, Artificial
  CRISPR gRNA sequence
aattaaatggtaactctata

SEQ ID NO: 816219 - DNA, 20 bp, Artificial
  CRISPR gRNA sequence
aatggtaactctatatttaa

SEQ ID NO: 816220 - DNA, 20 bp, Artificial
  CRISPR gRNA sequence
tatatttaactttttgagga

SEQ ID NO: 816221 - DNA, 20 bp, Artificial
  CRISPR gRNA sequence
tatttaactttttgaggaat

SEQ ID NO: 816222 - DNA, 20 bp, Artificial
  CRISPR gRNA sequence
aactttttgaggaattgcca

SEQ ID NO: 816223 - DNA, 20 bp, Artificial
  CRISPR gRNA sequence
actttttgaggaattgccaa

SEQ ID NO: 816224 - DNA, 20 bp, Artificial
  CRISPR gRNA sequence
tttgaggaattgccaaacta

SEQ ID NO: 816225 - DNA, 20 bp, Artificial
  CRISPR gRNA sequence
ttgaggaattgccaaactat

SEQ ID NO: 816226 - DNA, 20 bp, Artificial
  CRISPR gRNA sequence
tgaggaattgccaaactatt

SEQ ID NO: 816227 - DNA, 20 bp, Artificial
  CRISPR gRNA sequence
gaggaattgccaaactattt

SEQ ID NO: 816228 - DNA, 20 bp, Artificial
  CRISPR gRNA sequence
aggaattgccaaactattta

SEQ ID NO: 816229 - DNA, 20 bp, Artificial
  CRISPR gRNA sequence
ccaaactatttatcaaatat

SEQ ID NO: 816230 - DNA, 20 bp, Artificial
  CRISPR gRNA sequence
tttatcaaatatatgatttg

SEQ ID NO: 816231 - DNA, 20 bp, Artificial
  CRISPR gRNA sequence
atcaaatatatgatttggaa

SEQ ID NO: 816232 - DNA, 20 bp, Artificial
  CRISPR gRNA sequence
tcaaatatatgatttggaaa

SEQ ID NO: 816233 - DNA, 20 bp, Artificial
  CRISPR gRNA sequence
ggaaatattttttcccattc

SEQ ID NO: 816234 - DNA, 20 bp, Artificial
  CRISPR gRNA sequence
gaaatattttttcccattct

SEQ ID NO: 816235 - DNA, 20 bp, Artificial
  CRISPR gRNA sequence
tttcccattctgcacattgt

SEQ ID NO: 816236 - DNA, 20 bp, Artificial
  CRISPR gRNA sequence
ttcccattctgcacattgtc

SEQ ID NO: 816237 - DNA, 20 bp, Artificial
  CRISPR gRNA sequence
tcccattctgcacattgtct

SEQ ID NO: 816238 - DNA, 20 bp, Artificial
  CRISPR gRNA sequence
cccattctgcacattgtctt

SEQ ID NO: 816239 - DNA, 20 bp, Artificial
  CRISPR gRNA sequence
ccattctgcacattgtcttt

SEQ ID NO: 816240 - DNA, 20 bp, Artificial
  CRISPR gRNA sequence
tgcacattgtcttttcagtt

SEQ ID NO: 816241 - DNA, 20 bp, Artificial
  CRISPR gRNA sequence
cacattgtcttttcagtttc

SEQ ID NO: 816242 - DNA, 20 bp, Artificial
  CRISPR gRNA sequence
tcttttcagtttctttatag

SEQ ID NO: 816243 - DNA, 20 bp, Artificial
  CRISPR gRNA sequence
ttcagtttctttatagaatc

SEQ ID NO: 816244 - DNA, 20 bp, Artificial
  CRISPR gRNA sequence
tcagtttctttatagaatcc

SEQ ID NO: 816245 - DNA, 20 bp, Artificial
  CRISPR gRNA sequence
cagtttctttatagaatcct

SEQ ID NO: 816246 - DNA, 20 bp, Artificial
  CRISPR gRNA sequence
agtttctttatagaatcctg

SEQ ID NO: 816247 - DNA, 20 bp, Artificial
  CRISPR gRNA sequence
ctttatagaatcctgtgaag

SEQ ID NO: 816248 - DNA, 20 bp, Artificial
  CRISPR gRNA sequence
tttatagaatcctgtgaagg

SEQ ID NO: 816249 - DNA, 20 bp, Artificial
  CRISPR gRNA sequence
tatagaatcctgtgaaggat

SEQ ID NO: 816250 - DNA, 20 bp, Artificial
  CRISPR gRNA sequence
atagaatcctgtgaaggata

SEQ ID NO: 816251 - DNA, 20 bp, Artificial
  CRISPR gRNA sequence
tagaatcctgtgaaggataa

SEQ ID NO: 816252 - DNA, 20 bp, Artificial
  CRISPR gRNA sequence
tgaaggataaatgttttaat

SEQ ID NO: 816253 - DNA, 20 bp, Artificial
  CRISPR gRNA sequence
taatttaattttgattttat

SEQ ID NO: 816254 - DNA, 20 bp, Artificial
  CRISPR gRNA sequence
aatttaattttgattttatt

SEQ ID NO: 816255 - DNA, 20 bp, Artificial
  CRISPR gRNA sequence
atttaattttgattttattt

SEQ ID NO: 816256 - DNA, 20 bp, Artificial
  CRISPR gRNA sequence
aattttgattttatttaatt

SEQ ID NO: 816257 - DNA, 20 bp, Artificial
  CRISPR gRNA sequence
attttgattttatttaattt

SEQ ID NO: 816258 - DNA, 20 bp, Artificial
  CRISPR gRNA sequence
tgattttatttaattttgaa

SEQ ID NO: 816259 - DNA, 20 bp, Artificial
  CRISPR gRNA sequence
gattttatttaattttgaaa

SEQ ID NO: 816260 - DNA, 20 bp, Artificial
  CRISPR gRNA sequence
attttatttaattttgaaac

SEQ ID NO: 816261 - DNA, 20 bp, Artificial
  CRISPR gRNA sequence
tatttaattttgaaacacaa

SEQ ID NO: 816262 - DNA, 20 bp, Artificial
  CRISPR gRNA sequence
atttaattttgaaacacaaa

SEQ ID NO: 816263 - DNA, 20 bp, Artificial
  CRISPR gRNA sequence
tttaattttgaaacacaaat

SEQ ID NO: 816264 - DNA, 20 bp, Artificial
  CRISPR gRNA sequence
aattttgaaacacaaattga

SEQ ID NO: 816265 - DNA, 20 bp, Artificial
  CRISPR gRNA sequence
attttgaaacacaaattgat

SEQ ID NO: 816266 - DNA, 20 bp, Artificial
  CRISPR gRNA sequence
tgaaacacaaattgatttta

SEQ ID NO: 816267 - DNA, 20 bp, Artificial
  CRISPR gRNA sequence
gaaacacaaattgattttaa

SEQ ID NO: 816268 - DNA, 20 bp, Artificial
  CRISPR gRNA sequence
aaacacaaattgattttaag

SEQ ID NO: 816269 - DNA, 20 bp, Artificial
  CRISPR gRNA sequence
attttaagtaaaaaaatcca

SEQ ID NO: 816270 - DNA, 20 bp, Artificial
  CRISPR gRNA sequence
taagtaaaaaaatccaattt

SEQ ID NO: 816271 - DNA, 20 bp, Artificial
  CRISPR gRNA sequence
aagtaaaaaaatccaattta

SEQ ID NO: 816272 - DNA, 20 bp, Artificial
  CRISPR gRNA sequence
agtaaaaaaatccaatttat

SEQ ID NO: 816273 - DNA, 20 bp, Artificial
  CRISPR gRNA sequence
atctacttttttcttttatt

SEQ ID NO: 816274 - DNA, 20 bp, Artificial
  CRISPR gRNA sequence
tctacttttttcttttattg

SEQ ID NO: 816275 - DNA, 20 bp, Artificial
  CRISPR gRNA sequence
cttttttcttttattgtttg

SEQ ID NO: 816276 - DNA, 20 bp, Artificial
  CRISPR gRNA sequence
ttttcttttattgtttgtgc

SEQ ID NO: 816277 - DNA, 20 bp, Artificial
  CRISPR gRNA sequence
tttcttttattgtttgtgct

SEQ ID NO: 816278 - DNA, 20 bp, Artificial
  CRISPR gRNA sequence
ttcttttattgtttgtgctt

SEQ ID NO: 816279 - DNA, 20 bp, Artificial
  CRISPR gRNA sequence
tcttttattgtttgtgcttt

SEQ ID NO: 816280 - DNA, 20 bp, Artificial
  CRISPR gRNA sequence
cttttattgtttgtgcttta

SEQ ID NO: 816281 - DNA, 20 bp, Artificial
  CRISPR gRNA sequence
ttttattgtttgtgctttag

SEQ ID NO: 816282 - DNA, 20 bp, Artificial
  CRISPR gRNA sequence
ttattgtttgtgctttaggt

SEQ ID NO: 816283 - DNA, 20 bp, Artificial
  CRISPR gRNA sequence
tattgtttgtgctttaggtg

SEQ ID NO: 816284 - DNA, 20 bp, Artificial
  CRISPR gRNA sequence
attgtttgtgctttaggtgt

SEQ ID NO: 816285 - DNA, 20 bp, Artificial
  CRISPR gRNA sequence
ttgtttgtgctttaggtgta

SEQ ID NO: 816286 - DNA, 20 bp, Artificial
  CRISPR gRNA sequence
tttgtgctttaggtgtaata

SEQ ID NO: 816287 - DNA, 20 bp, Artificial
  CRISPR gRNA sequence
gtgctttaggtgtaatacct

SEQ ID NO: 816288 - DNA, 20 bp, Artificial
  CRISPR gRNA sequence
tgctttaggtgtaataccta

SEQ ID NO: 816289 - DNA, 20 bp, Artificial
  CRISPR gRNA sequence
taggtgtaatacctaagaaa

SEQ ID NO: 816290 - DNA, 20 bp, Artificial
  CRISPR gRNA sequence
aggtgtaatacctaagaaac

SEQ ID NO: 816291 - DNA, 20 bp, Artificial
  CRISPR gRNA sequence
ggtgtaatacctaagaaacc

SEQ ID NO: 816292 - DNA, 20 bp, Artificial
  CRISPR gRNA sequence
agaaaccattgcctagtcaa

SEQ ID NO: 816293 - DNA, 20 bp, Artificial
  CRISPR gRNA sequence
cctagtcaaggtcacaaaga

SEQ ID NO: 816294 - DNA, 20 bp, Artificial
  CRISPR gRNA sequence
gtcaaggtcacaaagattta

SEQ ID NO: 816295 - DNA, 20 bp, Artificial
  CRISPR gRNA sequence
acatctgtattttctgctaa

SEQ ID NO: 816296 - DNA, 20 bp, Artificial
  CRISPR gRNA sequence
catctgtattttctgctaag

SEQ ID NO: 816297 - DNA, 20 bp, Artificial
  CRISPR gRNA sequence
tattttctgctaagataaat

SEQ ID NO: 816298 - DNA, 20 bp, Artificial
  CRISPR gRNA sequence
tctgctaagataaatataaa

SEQ ID NO: 816299 - DNA, 20 bp, Artificial
  CRISPR gRNA sequence
ctgctaagataaatataaat

SEQ ID NO: 816300 - DNA, 20 bp, Artificial
  CRISPR gRNA sequence
tgctaagataaatataaatg

SEQ ID NO: 816301 - DNA, 20 bp, Artificial
  CRISPR gRNA sequence
ctaagataaatataaatgga

SEQ ID NO: 816302 - DNA, 20 bp, Artificial
  CRISPR gRNA sequence
agataaatataaatggagca

SEQ ID NO: 816303 - DNA, 20 bp, Artificial
  CRISPR gRNA sequence
tacagggacaactggatgtc

SEQ ID NO: 816304 - DNA, 20 bp, Artificial
  CRISPR gRNA sequence
gatgtccacatgcaaaagaa

SEQ ID NO: 816305 - DNA, 20 bp, Artificial
  CRISPR gRNA sequence
ggagccttacctcataccat

SEQ ID NO: 816306 - DNA, 20 bp, Artificial
  CRISPR gRNA sequence
gagccttacctcataccata

SEQ ID NO: 816307 - DNA, 20 bp, Artificial
  CRISPR gRNA sequence
acctcataccatatacaaaa

SEQ ID NO: 816308 - DNA, 20 bp, Artificial
  CRISPR gRNA sequence
cctcataccatatacaaaaa

SEQ ID NO: 816309 - DNA, 20 bp, Artificial
  CRISPR gRNA sequence
ataccatatacaaaaattaa

SEQ ID NO: 816310 - DNA, 20 bp, Artificial
  CRISPR gRNA sequence
aacaaaatggatcaagaacc

SEQ ID NO: 816311 - DNA, 20 bp, Artificial
  CRISPR gRNA sequence
aatataagaactttagttcc

SEQ ID NO: 816312 - DNA, 20 bp, Artificial
  CRISPR gRNA sequence
tagttccaaatttgttctac

SEQ ID NO: 816313 - DNA, 20 bp, Artificial
  CRISPR gRNA sequence
agttccaaatttgttctact

SEQ ID NO: 816314 - DNA, 20 bp, Artificial
  CRISPR gRNA sequence
gttccaaatttgttctactg

SEQ ID NO: 816315 - DNA, 20 bp, Artificial
  CRISPR gRNA sequence
caaatttgttctactgattg

SEQ ID NO: 816316 - DNA, 20 bp, Artificial
  CRISPR gRNA sequence
gttctactgattgtgggcat

SEQ ID NO: 816317 - DNA, 20 bp, Artificial
  CRISPR gRNA sequence
ttctactgattgtgggcatt

SEQ ID NO: 816318 - DNA, 20 bp, Artificial
  CRISPR gRNA sequence
tactgattgtgggcattcag

SEQ ID NO: 816319 - DNA, 20 bp, Artificial
  CRISPR gRNA sequence
ctgattgtgggcattcagtt

SEQ ID NO: 816320 - DNA, 20 bp, Artificial
  CRISPR gRNA sequence
attgtgggcattcagttgtg

SEQ ID NO: 816321 - DNA, 20 bp, Artificial
  CRISPR gRNA sequence
tgggcattcagttgtgcctg

SEQ ID NO: 816322 - DNA, 20 bp, Artificial
  CRISPR gRNA sequence
agttgtgcctgtacaatttg

SEQ ID NO: 816323 - DNA, 20 bp, Artificial
  CRISPR gRNA sequence
tgcctgtacaatttgttgag

SEQ ID NO: 816324 - DNA, 20 bp, Artificial
  CRISPR gRNA sequence
tacaatttgttgaggaaatt

SEQ ID NO: 816325 - DNA, 20 bp, Artificial
  CRISPR gRNA sequence
gttgaggaaattattctttc

SEQ ID NO: 816326 - DNA, 20 bp, Artificial
  CRISPR gRNA sequence
ttgaggaaattattctttcc

SEQ ID NO: 816327 - DNA, 20 bp, Artificial
  CRISPR gRNA sequence
aggaaattattctttcccta

SEQ ID NO: 816328 - DNA, 20 bp, Artificial
  CRISPR gRNA sequence
ttctttccctattgaactgt

SEQ ID NO: 816329 - DNA, 20 bp, Artificial
  CRISPR gRNA sequence
tttccctattgaactgtctt

SEQ ID NO: 816330 - DNA, 20 bp, Artificial
  CRISPR gRNA sequence
tccctattgaactgtcttgg

SEQ ID NO: 816331 - DNA, 20 bp, Artificial
  CRISPR gRNA sequence
ccctattgaactgtcttggc

SEQ ID NO: 816332 - DNA, 20 bp, Artificial
  CRISPR gRNA sequence
cctattgaactgtcttggca

SEQ ID NO: 816333 - DNA, 20 bp, Artificial
  CRISPR gRNA sequence
ttgaactgtcttggcaccct

SEQ ID NO: 816334 - DNA, 20 bp, Artificial
  CRISPR gRNA sequence
aactgtcttggcacccttgc

SEQ ID NO: 816335 - DNA, 20 bp, Artificial
  CRISPR gRNA sequence
tcttggcacccttgcaaaac

SEQ ID NO: 816336 - DNA, 20 bp, Artificial
  CRISPR gRNA sequence
ggcacccttgcaaaacatca

SEQ ID NO: 816337 - DNA, 20 bp, Artificial
  CRISPR gRNA sequence
gcacccttgcaaaacatcaa

SEQ ID NO: 816338 - DNA, 20 bp, Artificial
  CRISPR gRNA sequence
gcaaaacatcaattgatcat

SEQ ID NO: 816339 - DNA, 20 bp, Artificial
  CRISPR gRNA sequence
caaaacatcaattgatcata

SEQ ID NO: 816340 - DNA, 20 bp, Artificial
  CRISPR gRNA sequence
atcatatatataaggatgta

SEQ ID NO: 816341 - DNA, 20 bp, Artificial
  CRISPR gRNA sequence
ctggactctcgattctgttt

SEQ ID NO: 816342 - DNA, 20 bp, Artificial
  CRISPR gRNA sequence
tggactctcgattctgtttt

SEQ ID NO: 816343 - DNA, 20 bp, Artificial
  CRISPR gRNA sequence
gactctcgattctgttttat

SEQ ID NO: 816344 - DNA, 20 bp, Artificial
  CRISPR gRNA sequence
tcgattctgttttattgaac

SEQ ID NO: 816345 - DNA, 20 bp, Artificial
  CRISPR gRNA sequence
gattctgttttattgaacta

SEQ ID NO: 816346 - DNA, 20 bp, Artificial
  CRISPR gRNA sequence
tgttttattgaactatatgt

SEQ ID NO: 816347 - DNA, 20 bp, Artificial
  CRISPR gRNA sequence
ttttattgaactatatgtct

SEQ ID NO: 816348 - DNA, 20 bp, Artificial
  CRISPR gRNA sequence
tattgaactatatgtctatc

SEQ ID NO: 816349 - DNA, 20 bp, Artificial
  CRISPR gRNA sequence
attgaactatatgtctatcc

SEQ ID NO: 816350 - DNA, 20 bp, Artificial
  CRISPR gRNA sequence
ttgaactatatgtctatcct

SEQ ID NO: 816351 - DNA, 20 bp, Artificial
  CRISPR gRNA sequence
aactatatgtctatcctatg

SEQ ID NO: 816352 - DNA, 20 bp, Artificial
  CRISPR gRNA sequence
tatgtctatcctatgtcagt

SEQ ID NO: 816353 - DNA, 20 bp, Artificial
  CRISPR gRNA sequence
tcctatgtcagtaccacaca

SEQ ID NO: 816354 - DNA, 20 bp, Artificial
  CRISPR gRNA sequence
tgtcagtaccacacagcgtt

SEQ ID NO: 816355 - DNA, 20 bp, Artificial
  CRISPR gRNA sequence
attactgtagctttgtagta

SEQ ID NO: 816356 - DNA, 20 bp, Artificial
  CRISPR gRNA sequence
ctgtagctttgtagtaagtt

SEQ ID NO: 816357 - DNA, 20 bp, Artificial
  CRISPR gRNA sequence
tagctttgtagtaagttttg

SEQ ID NO: 816358 - DNA, 20 bp, Artificial
  CRISPR gRNA sequence
tgtagtaagttttgaaactg

SEQ ID NO: 816359 - DNA, 20 bp, Artificial
  CRISPR gRNA sequence
gtagtaagttttgaaactgg

SEQ ID NO: 816360 - DNA, 20 bp, Artificial
  CRISPR gRNA sequence
tagtaagttttgaaactgga

SEQ ID NO: 816361 - DNA, 20 bp, Artificial
  CRISPR gRNA sequence
tgaaactggaaagtgtgagt

SEQ ID NO: 816362 - DNA, 20 bp, Artificial
  CRISPR gRNA sequence
gaaactggaaagtgtgagtc

SEQ ID NO: 816363 - DNA, 20 bp, Artificial
  CRISPR gRNA sequence
aaactggaaagtgtgagtcc

SEQ ID NO: 816364 - DNA, 20 bp, Artificial
  CRISPR gRNA sequence
gaaagtgtgagtcctccaac

SEQ ID NO: 816365 - DNA, 20 bp, Artificial
  CRISPR gRNA sequence
caactttgttagtctttttc

SEQ ID NO: 816366 - DNA, 20 bp, Artificial
  CRISPR gRNA sequence
tgttagtctttttcaagatt

SEQ ID NO: 816367 - DNA, 20 bp, Artificial
  CRISPR gRNA sequence
gttagtctttttcaagattt

SEQ ID NO: 816368 - DNA, 20 bp, Artificial
  CRISPR gRNA sequence
ttagtctttttcaagatttt

SEQ ID NO: 816369 - DNA, 20 bp, Artificial
  CRISPR gRNA sequence
gtctttttcaagattttttt

SEQ ID NO: 816370 - DNA, 20 bp, Artificial
  CRISPR gRNA sequence
tttcaagatttttttttagg

SEQ ID NO: 816371 - DNA, 20 bp, Artificial
  CRISPR gRNA sequence
ttcaagatttttttttaggg

SEQ ID NO: 816372 - DNA, 20 bp, Artificial
  CRISPR gRNA sequence
tcaagatttttttttagggg

SEQ ID NO: 816373 - DNA, 20 bp, Artificial
  CRISPR gRNA sequence
caagatttttttttaggggg

SEQ ID NO: 816374 - DNA, 20 bp, Artificial
  CRISPR gRNA sequence
aagatttttttttagggggc

SEQ ID NO: 816375 - DNA, 20 bp, Artificial
  CRISPR gRNA sequence
ttttttagggggctattcgg

SEQ ID NO: 816376 - DNA, 20 bp, Artificial
  CRISPR gRNA sequence
tttttagggggctattcggg

SEQ ID NO: 816377 - DNA, 20 bp, Artificial
  CRISPR gRNA sequence
ttttagggggctattcgggc

SEQ ID NO: 816378 - DNA, 20 bp, Artificial
  CRISPR gRNA sequence
tttagggggctattcgggct

SEQ ID NO: 816379 - DNA, 20 bp, Artificial
  CRISPR gRNA sequence
ttagggggctattcgggctt

SEQ ID NO: 816380 - DNA, 20 bp, Artificial
  CRISPR gRNA sequence
tagggggctattcgggcttc

SEQ ID NO: 816381 - DNA, 20 bp, Artificial
  CRISPR gRNA sequence
agggggctattcgggcttcc

SEQ ID NO: 816382 - DNA, 20 bp, Artificial
  CRISPR gRNA sequence
gggggctattcgggcttcct

SEQ ID NO: 816383 - DNA, 20 bp, Artificial
  CRISPR gRNA sequence
ttcgggcttccttacatttt

SEQ ID NO: 816384 - DNA, 20 bp, Artificial
  CRISPR gRNA sequence
gggcttccttacattttcaa

SEQ ID NO: 816385 - DNA, 20 bp, Artificial
  CRISPR gRNA sequence
ccttacattttcaaatgaat

SEQ ID NO: 816386 - DNA, 20 bp, Artificial
  CRISPR gRNA sequence
cttacattttcaaatgaatt

SEQ ID NO: 816387 - DNA, 20 bp, Artificial
  CRISPR gRNA sequence
acattttcaaatgaatttta

SEQ ID NO: 816388 - DNA, 20 bp, Artificial
  CRISPR gRNA sequence
cattttcaaatgaattttag

SEQ ID NO: 816389 - DNA, 20 bp, Artificial
  CRISPR gRNA sequence
tcaaatgaattttagggtca

SEQ ID NO: 816390 - DNA, 20 bp, Artificial
  CRISPR gRNA sequence
caaatgaattttagggtcaa

SEQ ID NO: 816391 - DNA, 20 bp, Artificial
  CRISPR gRNA sequence
aaatgaattttagggtcaac

SEQ ID NO: 816392 - DNA, 20 bp, Artificial
  CRISPR gRNA sequence
tagggtcaacttgctcattt

SEQ ID NO: 816393 - DNA, 20 bp, Artificial
  CRISPR gRNA sequence
agggtcaacttgctcatttc

SEQ ID NO: 816394 - DNA, 20 bp, Artificial
  CRISPR gRNA sequence
gggtcaacttgctcatttct

SEQ ID NO: 816395 - DNA, 20 bp, Artificial
  CRISPR gRNA sequence
gctcatttctgcagacaaag

SEQ ID NO: 816396 - DNA, 20 bp, Artificial
  CRISPR gRNA sequence
ctcatttctgcagacaaagg

SEQ ID NO: 816397 - DNA, 20 bp, Artificial
  CRISPR gRNA sequence
atttctgcagacaaaggaag

SEQ ID NO: 816398 - DNA, 20 bp, Artificial
  CRISPR gRNA sequence
ctgcagacaaaggaagctgg

SEQ ID NO: 816399 - DNA, 20 bp, Artificial
  CRISPR gRNA sequence
tgcagacaaaggaagctgga

SEQ ID NO: 816400 - DNA, 20 bp, Artificial
  CRISPR gRNA sequence
cagacaaaggaagctggaat

SEQ ID NO: 816401 - DNA, 20 bp, Artificial
  CRISPR gRNA sequence
gaattttggtagggattgca

SEQ ID NO: 816402 - DNA, 20 bp, Artificial
  CRISPR gRNA sequence
tggtagggattgcattgaat

SEQ ID NO: 816403 - DNA, 20 bp, Artificial
  CRISPR gRNA sequence
ggtagggattgcattgaatc

SEQ ID NO: 816404 - DNA, 20 bp, Artificial
  CRISPR gRNA sequence
gtagggattgcattgaatcc

SEQ ID NO: 816405 - DNA, 20 bp, Artificial
  CRISPR gRNA sequence
cattgaatccatagatcaat

SEQ ID NO: 816406 - DNA, 20 bp, Artificial
  CRISPR gRNA sequence
aatccatagatcaatttggg

SEQ ID NO: 816407 - DNA, 20 bp, Artificial
  CRISPR gRNA sequence
ggggaatacagccagctgaa

SEQ ID NO: 816408 - DNA, 20 bp, Artificial
  CRISPR gRNA sequence
gggaatacagccagctgaat

SEQ ID NO: 816409 - DNA, 20 bp, Artificial
  CRISPR gRNA sequence
aataatatttagtcttccaa

SEQ ID NO: 816410 - DNA, 20 bp, Artificial
  CRISPR gRNA sequence
agtcttccaattcatgaata

SEQ ID NO: 816411 - DNA, 20 bp, Artificial
  CRISPR gRNA sequence
gtcttccaattcatgaatac

SEQ ID NO: 816412 - DNA, 20 bp, Artificial
  CRISPR gRNA sequence
ccaattcatgaatacagcat

SEQ ID NO: 816413 - DNA, 20 bp, Artificial
  CRISPR gRNA sequence
caattcatgaatacagcatg

SEQ ID NO: 816414 - DNA, 20 bp, Artificial
  CRISPR gRNA sequence
atgaatacagcatgtctttc

SEQ ID NO: 816415 - DNA, 20 bp, Artificial
  CRISPR gRNA sequence
tcctttgtttaggccttcta

SEQ ID NO: 816416 - DNA, 20 bp, Artificial
  CRISPR gRNA sequence
cctttgtttaggccttctat

SEQ ID NO: 816417 - DNA, 20 bp, Artificial
  CRISPR gRNA sequence
ctttgtttaggccttctata

SEQ ID NO: 816418 - DNA, 20 bp, Artificial
  CRISPR gRNA sequence
tgtttaggccttctatagtt

SEQ ID NO: 816419 - DNA, 20 bp, Artificial
  CRISPR gRNA sequence
gtttaggccttctatagttt

SEQ ID NO: 816420 - DNA, 20 bp, Artificial
  CRISPR gRNA sequence
tttaggccttctatagtttg

SEQ ID NO: 816421 - DNA, 20 bp, Artificial
  CRISPR gRNA sequence
aggccttctatagtttgaaa

SEQ ID NO: 816422 - DNA, 20 bp, Artificial
  CRISPR gRNA sequence
ggccttctatagtttgaaaa

SEQ ID NO: 816423 - DNA, 20 bp, Artificial
  CRISPR gRNA sequence
ctatagtttgaaaaaagacc

SEQ ID NO: 816424 - DNA, 20 bp, Artificial
  CRISPR gRNA sequence
tatagtttgaaaaaagacct

SEQ ID NO: 816425 - DNA, 20 bp, Artificial
  CRISPR gRNA sequence
tagtttgaaaaaagacctga

SEQ ID NO: 816426 - DNA, 20 bp, Artificial
  CRISPR gRNA sequence
gaaaaaagacctgaagggaa

SEQ ID NO: 816427 - DNA, 20 bp, Artificial
  CRISPR gRNA sequence
aaaaaagacctgaagggaac

SEQ ID NO: 816428 - DNA, 20 bp, Artificial
  CRISPR gRNA sequence
aagggaactgctgacaggct

SEQ ID NO: 816429 - DNA, 20 bp, Artificial
  CRISPR gRNA sequence
ctgacaggctagatatatag

SEQ ID NO: 816430 - DNA, 20 bp, Artificial
  CRISPR gRNA sequence
acaggctagatatatagttt

SEQ ID NO: 816431 - DNA, 20 bp, Artificial
  CRISPR gRNA sequence
gatatatagtttgagaaaaa

SEQ ID NO: 816432 - DNA, 20 bp, Artificial
  CRISPR gRNA sequence
gagaaaaagagggaaatctg

SEQ ID NO: 816433 - DNA, 20 bp, Artificial
  CRISPR gRNA sequence
agaaaaagagggaaatctgg

SEQ ID NO: 816434 - DNA, 20 bp, Artificial
  CRISPR gRNA sequence
ggaaaattcctaagtttggg

SEQ ID NO: 816435 - DNA, 20 bp, Artificial
  CRISPR gRNA sequence
ctaagtttggggcttgagtc

SEQ ID NO: 816436 - DNA, 20 bp, Artificial
  CRISPR gRNA sequence
agtttggggcttgagtcact

SEQ ID NO: 816437 - DNA, 20 bp, Artificial
  CRISPR gRNA sequence
ggggcttgagtcactaaggc

SEQ ID NO: 816438 - DNA, 20 bp, Artificial
  CRISPR gRNA sequence
gggcttgagtcactaaggca

SEQ ID NO: 816439 - DNA, 20 bp, Artificial
  CRISPR gRNA sequence
gagtcactaaggcaatggag

SEQ ID NO: 816440 - DNA, 20 bp, Artificial
  CRISPR gRNA sequence
agtcactaaggcaatggaga

SEQ ID NO: 816441 - DNA, 20 bp, Artificial
  CRISPR gRNA sequence
aggcaatggagatgctgttt

SEQ ID NO: 816442 - DNA, 20 bp, Artificial
  CRISPR gRNA sequence
tttattaaaatggagaaggc

SEQ ID NO: 816443 - DNA, 20 bp, Artificial
  CRISPR gRNA sequence
attaaaatggagaaggctgg

SEQ ID NO: 816444 - DNA, 20 bp, Artificial
  CRISPR gRNA sequence
ttaaaatggagaaggctggg

SEQ ID NO: 816445 - DNA, 20 bp, Artificial
  CRISPR gRNA sequence
aaatggagaaggctggggga

SEQ ID NO: 816446 - DNA, 20 bp, Artificial
  CRISPR gRNA sequence
ggggagaagcaaattaagga

SEQ ID NO: 816447 - DNA, 20 bp, Artificial
  CRISPR gRNA sequence
aggaaggggaaaaagagtta

SEQ ID NO: 816448 - DNA, 20 bp, Artificial
  CRISPR gRNA sequence
cgtttgttgtagatttggtt

SEQ ID NO: 816449 - DNA, 20 bp, Artificial
  CRISPR gRNA sequence
gttgtagatttggtttgaaa

SEQ ID NO: 816450 - DNA, 20 bp, Artificial
  CRISPR gRNA sequence
ttgtagatttggtttgaaat

SEQ ID NO: 816451 - DNA, 20 bp, Artificial
  CRISPR gRNA sequence
tagatttggtttgaaatgcc

SEQ ID NO: 816452 - DNA, 20 bp, Artificial
  CRISPR gRNA sequence
ggtttgaaatgcctattaga

SEQ ID NO: 816453 - DNA, 20 bp, Artificial
  CRISPR gRNA sequence
gtttgaaatgcctattagat

SEQ ID NO: 816454 - DNA, 20 bp, Artificial
  CRISPR gRNA sequence
gaaatgcctattagatagcc

SEQ ID NO: 816455 - DNA, 20 bp, Artificial
  CRISPR gRNA sequence
aaatgcctattagatagcca

SEQ ID NO: 816456 - DNA, 20 bp, Artificial
  CRISPR gRNA sequence
ttagatagccaagtggaggt

SEQ ID NO: 816457 - DNA, 20 bp, Artificial
  CRISPR gRNA sequence
gatagccaagtggaggtgtt

SEQ ID NO: 816458 - DNA, 20 bp, Artificial
  CRISPR gRNA sequence
agtaggcagttggggtagag

SEQ ID NO: 816459 - DNA, 20 bp, Artificial
  CRISPR gRNA sequence
gtaggcagttggggtagaga

SEQ ID NO: 816460 - DNA, 20 bp, Artificial
  CRISPR gRNA sequence
gggtagagatgtaaatttag

SEQ ID NO: 816461 - DNA, 20 bp, Artificial
  CRISPR gRNA sequence
aggagtcatcaatgcagaag

SEQ ID NO: 816462 - DNA, 20 bp, Artificial
  CRISPR gRNA sequence
ggagtcatcaatgcagaagt

SEQ ID NO: 816463 - DNA, 20 bp, Artificial
  CRISPR gRNA sequence
aagatttaaagtcatggata

SEQ ID NO: 816464 - DNA, 20 bp, Artificial
  CRISPR gRNA sequence
aaagtcatggatatctgcat

SEQ ID NO: 816465 - DNA, 20 bp, Artificial
  CRISPR gRNA sequence
aagtcatggatatctgcatt

SEQ ID NO: 816466 - DNA, 20 bp, Artificial
  CRISPR gRNA sequence
cattacatcacctacagaga

SEQ ID NO: 816467 - DNA, 20 bp, Artificial
  CRISPR gRNA sequence
catcacctacagagagatag

SEQ ID NO: 816468 - DNA, 20 bp, Artificial
  CRISPR gRNA sequence
cagagagataggaaagagag

SEQ ID NO: 816469 - DNA, 20 bp, Artificial
  CRISPR gRNA sequence
agacatggggtattccaaca

SEQ ID NO: 816470 - DNA, 20 bp, Artificial
  CRISPR gRNA sequence
caacatttatagatctttgt

SEQ ID NO: 816471 - DNA, 20 bp, Artificial
  CRISPR gRNA sequence
atagatctttgtgaagagcg

SEQ ID NO: 816472 - DNA, 20 bp, Artificial
  CRISPR gRNA sequence
tagatctttgtgaagagcgg

SEQ ID NO: 816473 - DNA, 20 bp, Artificial
  CRISPR gRNA sequence
tgtgaagagcggtcaccagc

SEQ ID NO: 816474 - DNA, 20 bp, Artificial
  CRISPR gRNA sequence
gtgaagagcggtcaccagca

SEQ ID NO: 816475 - DNA, 20 bp, Artificial
  CRISPR gRNA sequence
tgaagagcggtcaccagcag

SEQ ID NO: 816476 - DNA, 20 bp, Artificial
  CRISPR gRNA sequence
aaaggaagggtacaaaggca

SEQ ID NO: 816477 - DNA, 20 bp, Artificial
  CRISPR gRNA sequence
tccatgcattttattttctg

SEQ ID NO: 816478 - DNA, 20 bp, Artificial
  CRISPR gRNA sequence
tattttctgtattctgatgc

SEQ ID NO: 816479 - DNA, 20 bp, Artificial
  CRISPR gRNA sequence
attttctgtattctgatgct

SEQ ID NO: 816480 - DNA, 20 bp, Artificial
  CRISPR gRNA sequence
ttttctgtattctgatgctt

SEQ ID NO: 816481 - DNA, 20 bp, Artificial
  CRISPR gRNA sequence
tctgtattctgatgctttga

SEQ ID NO: 816482 - DNA, 20 bp, Artificial
  CRISPR gRNA sequence
ctgtattctgatgctttgac

SEQ ID NO: 816483 - DNA, 20 bp, Artificial
  CRISPR gRNA sequence
tgtattctgatgctttgaca

SEQ ID NO: 816484 - DNA, 20 bp, Artificial
  CRISPR gRNA sequence
tattctgatgctttgacacc

SEQ ID NO: 816485 - DNA, 20 bp, Artificial
  CRISPR gRNA sequence
tgatgctttgacacctgggg

SEQ ID NO: 816486 - DNA, 20 bp, Artificial
  CRISPR gRNA sequence
atgctttgacacctggggcc

SEQ ID NO: 816487 - DNA, 20 bp, Artificial
  CRISPR gRNA sequence
tgacacctggggccttgctg

SEQ ID NO: 816488 - DNA, 20 bp, Artificial
  CRISPR gRNA sequence
gacacctggggccttgctga

SEQ ID NO: 816489 - DNA, 20 bp, Artificial
  CRISPR gRNA sequence
acacctggggccttgctgac

SEQ ID NO: 816490 - DNA, 20 bp, Artificial
  CRISPR gRNA sequence
gggccttgctgaccctgaag

SEQ ID NO: 816491 - DNA, 20 bp, Artificial
  CRISPR gRNA sequence
gctgaccctgaagggactgc

SEQ ID NO: 816492 - DNA, 20 bp, Artificial
  CRISPR gRNA sequence
ctgaccctgaagggactgcc

SEQ ID NO: 816493 - DNA, 20 bp, Artificial
  CRISPR gRNA sequence
accctgaagggactgccgct

SEQ ID NO: 816494 - DNA, 20 bp, Artificial
  CRISPR gRNA sequence
aagggactgccgctcccagg

SEQ ID NO: 816495 - DNA, 20 bp, Artificial
  CRISPR gRNA sequence
ccgctcccagggttagccaa

SEQ ID NO: 816496 - DNA, 20 bp, Artificial
  CRISPR gRNA sequence
ccagggttagccaattctaa

SEQ ID NO: 816497 - DNA, 20 bp, Artificial
  CRISPR gRNA sequence
gccaattctaacctctaaga

SEQ ID NO: 816498 - DNA, 20 bp, Artificial
  CRISPR gRNA sequence
taacctctaagagagagtaa

SEQ ID NO: 816499 - DNA, 20 bp, Artificial
  CRISPR gRNA sequence
acctctaagagagagtaaac

SEQ ID NO: 816500 - DNA, 20 bp, Artificial
  CRISPR gRNA sequence
taagagagagtaaaccactt

SEQ ID NO: 816501 - DNA, 20 bp, Artificial
  CRISPR gRNA sequence
agagagagtaaaccacttgc

SEQ ID NO: 816502 - DNA, 20 bp, Artificial
  CRISPR gRNA sequence
gcccatgagcacacctttca

SEQ ID NO: 816503 - DNA, 20 bp, Artificial
  CRISPR gRNA sequence
cccatgagcacacctttcaa

SEQ ID NO: 816504 - DNA, 20 bp, Artificial
  CRISPR gRNA sequence
tcaaatgcaaaccaacccat

SEQ ID NO: 816505 - DNA, 20 bp, Artificial
  CRISPR gRNA sequence
caaatgcaaaccaacccatt

SEQ ID NO: 816506 - DNA, 20 bp, Artificial
  CRISPR gRNA sequence
aaatgcaaaccaacccattt

SEQ ID NO: 816507 - DNA, 20 bp, Artificial
  CRISPR gRNA sequence
cagagcccatacccacaact

SEQ ID NO: 816508 - DNA, 20 bp, Artificial
  CRISPR gRNA sequence
agagcccatacccacaactg

SEQ ID NO: 816509 - DNA, 20 bp, Artificial
  CRISPR gRNA sequence
cctcatttattgggggcttt

SEQ ID NO: 816510 - DNA, 20 bp, Artificial
  CRISPR gRNA sequence
atttattgggggctttcaca

SEQ ID NO: 816511 - DNA, 20 bp, Artificial
  CRISPR gRNA sequence
attgggggctttcacattcc

SEQ ID NO: 816512 - DNA, 20 bp, Artificial
  CRISPR gRNA sequence
ttgggggctttcacattccc

SEQ ID NO: 816513 - DNA, 20 bp, Artificial
  CRISPR gRNA sequence
ggggctttcacattcccaac

SEQ ID NO: 816514 - DNA, 20 bp, Artificial
  CRISPR gRNA sequence
tcacattcccaacactatgc

SEQ ID NO: 816515 - DNA, 20 bp, Artificial
  CRISPR gRNA sequence
cacattcccaacactatgca

SEQ ID NO: 816516 - DNA, 20 bp, Artificial
  CRISPR gRNA sequence
acattcccaacactatgcaa

SEQ ID NO: 816517 - DNA, 20 bp, Artificial
  CRISPR gRNA sequence
ccaacactatgcaactgcct

SEQ ID NO: 816518 - DNA, 20 bp, Artificial
  CRISPR gRNA sequence
tgcaactgccttaatcaccc

SEQ ID NO: 816519 - DNA, 20 bp, Artificial
  CRISPR gRNA sequence
ccttaatcaccccagggcca

SEQ ID NO: 816520 - DNA, 20 bp, Artificial
  CRISPR gRNA sequence
aatcaccccagggccaagta

SEQ ID NO: 816521 - DNA, 20 bp, Artificial
  CRISPR gRNA sequence
atcaccccagggccaagtac

SEQ ID NO: 816522 - DNA, 20 bp, Artificial
  CRISPR gRNA sequence
gggacagcccctatgcccca

SEQ ID NO: 816523 - DNA, 20 bp, Artificial
  CRISPR gRNA sequence
tgccccagagcctgctgaaa

SEQ ID NO: 816524 - DNA, 20 bp, Artificial
  CRISPR gRNA sequence
ctgaaattatttatatcagc

SEQ ID NO: 816525 - DNA, 20 bp, Artificial
  CRISPR gRNA sequence
aaattatttatatcagctaa

SEQ ID NO: 816526 - DNA, 20 bp, Artificial
  CRISPR gRNA sequence
tttatatcagctaatcctaa

SEQ ID NO: 816527 - DNA, 20 bp, Artificial
  CRISPR gRNA sequence
atatcagctaatcctaaatc

SEQ ID NO: 816528 - DNA, 20 bp, Artificial
  CRISPR gRNA sequence
tatcagctaatcctaaatcc

SEQ ID NO: 816529 - DNA, 20 bp, Artificial
  CRISPR gRNA sequence
atcctaaatccactcaccct

SEQ ID NO: 816530 - DNA, 20 bp, Artificial
  CRISPR gRNA sequence
aatccactcaccctgcttca

SEQ ID NO: 816531 - DNA, 20 bp, Artificial
  CRISPR gRNA sequence
accctgcttcacccatttct

SEQ ID NO: 816532 - DNA, 20 bp, Artificial
  CRISPR gRNA sequence
cttcacccatttcttcctgt

SEQ ID NO: 816533 - DNA, 20 bp, Artificial
  CRISPR gRNA sequence
cacccatttcttcctgttga

SEQ ID NO: 816534 - DNA, 20 bp, Artificial
  CRISPR gRNA sequence
acccatttcttcctgttgaa

SEQ ID NO: 816535 - DNA, 20 bp, Artificial
  CRISPR gRNA sequence
cttcctgttgaaaccacaat

SEQ ID NO: 816536 - DNA, 20 bp, Artificial
  CRISPR gRNA sequence
ttcctgttgaaaccacaata

SEQ ID NO: 816537 - DNA, 20 bp, Artificial
  CRISPR gRNA sequence
cctgttgaaaccacaataaa

SEQ ID NO: 816538 - DNA, 20 bp, Artificial
  CRISPR gRNA sequence
ctgttgaaaccacaataaag

SEQ ID NO: 816539 - DNA, 20 bp, Artificial
  CRISPR gRNA sequence
ttgaaaccacaataaagatc

SEQ ID NO: 816540 - DNA, 20 bp, Artificial
  CRISPR gRNA sequence
aaaccacaataaagatcttg

SEQ ID NO: 816541 - DNA, 20 bp, Artificial
  CRISPR gRNA sequence
gcgcaccccccacccacctc

SEQ ID NO: 816542 - DNA, 20 bp, Artificial
  CRISPR gRNA sequence
cgcaccccccacccacctcc

SEQ ID NO: 816543 - DNA, 20 bp, Artificial
  CRISPR gRNA sequence
ctggctgaccctggtgcttc

SEQ ID NO: 816544 - DNA, 20 bp, Artificial
  CRISPR gRNA sequence
gctgaccctggtgcttcccc

SEQ ID NO: 816545 - DNA, 20 bp, Artificial
  CRISPR gRNA sequence
accctggtgcttccccatgt

SEQ ID NO: 816546 - DNA, 20 bp, Artificial
  CRISPR gRNA sequence
gtgcttccccatgtggccct

SEQ ID NO: 816547 - DNA, 20 bp, Artificial
  CRISPR gRNA sequence
ccccatgtggccctttgtgg

SEQ ID NO: 816548 - DNA, 20 bp, Artificial
  CRISPR gRNA sequence
cccatgtggccctttgtggc

SEQ ID NO: 816549 - DNA, 20 bp, Artificial
  CRISPR gRNA sequence
tgtggcatggtgtgcccccc

SEQ ID NO: 816550 - DNA, 20 bp, Artificial
  CRISPR gRNA sequence
gtggcatggtgtgcccccct

SEQ ID NO: 816551 - DNA, 20 bp, Artificial
  CRISPR gRNA sequence
tggcatggtgtgcccccctt

SEQ ID NO: 816552 - DNA, 20 bp, Artificial
  CRISPR gRNA sequence
ctcttgggatctgtgagtac

SEQ ID NO: 816553 - DNA, 20 bp, Artificial
  CRISPR gRNA sequence
tcttgggatctgtgagtaca

SEQ ID NO: 816554 - DNA, 20 bp, Artificial
  CRISPR gRNA sequence
ttgggatctgtgagtacaac

SEQ ID NO: 816555 - DNA, 20 bp, Artificial
  CRISPR gRNA sequence
gggatctgtgagtacaacat

SEQ ID NO: 816556 - DNA, 20 bp, Artificial
  CRISPR gRNA sequence
ggatctgtgagtacaacata

SEQ ID NO: 816557 - DNA, 20 bp, Artificial
  CRISPR gRNA sequence
tgagtacaacatactttttt

SEQ ID NO: 816558 - DNA, 20 bp, Artificial
  CRISPR gRNA sequence
ttttcaacgacagtcatttc

SEQ ID NO: 816559 - DNA, 20 bp, Artificial
  CRISPR gRNA sequence
tttcaacgacagtcatttcc

SEQ ID NO: 816560 - DNA, 20 bp, Artificial
  CRISPR gRNA sequence
ttcaacgacagtcatttcct

SEQ ID NO: 816561 - DNA, 20 bp, Artificial
  CRISPR gRNA sequence
tcaacgacagtcatttcctg

SEQ ID NO: 816562 - DNA, 20 bp, Artificial
  CRISPR gRNA sequence
caacgacagtcatttcctga

SEQ ID NO: 816563 - DNA, 20 bp, Artificial
  CRISPR gRNA sequence
aacgacagtcatttcctgat

SEQ ID NO: 816564 - DNA, 20 bp, Artificial
  CRISPR gRNA sequence
cctgatatattggcctcacc

SEQ ID NO: 816565 - DNA, 20 bp, Artificial
  CRISPR gRNA sequence
ctgatatattggcctcacca

SEQ ID NO: 816566 - DNA, 20 bp, Artificial
  CRISPR gRNA sequence
atatattggcctcaccatac

SEQ ID NO: 816567 - DNA, 20 bp, Artificial
  CRISPR gRNA sequence
gcctcaccatacctaaataa

SEQ ID NO: 816568 - DNA, 20 bp, Artificial
  CRISPR gRNA sequence
accatacctaaataataata

SEQ ID NO: 816569 - DNA, 20 bp, Artificial
  CRISPR gRNA sequence
aataataataaaacctatat

SEQ ID NO: 816570 - DNA, 20 bp, Artificial
  CRISPR gRNA sequence
tattttaaaacacagtgcta

SEQ ID NO: 816571 - DNA, 20 bp, Artificial
  CRISPR gRNA sequence
taaaacacagtgctacaaag

SEQ ID NO: 816572 - DNA, 20 bp, Artificial
  CRISPR gRNA sequence
aaaacacagtgctacaaagg

SEQ ID NO: 816573 - DNA, 20 bp, Artificial
  CRISPR gRNA sequence
aaacacagtgctacaaagga

SEQ ID NO: 816574 - DNA, 20 bp, Artificial
  CRISPR gRNA sequence
caaaggagtgatcagtagag

SEQ ID NO: 816575 - DNA, 20 bp, Artificial
  CRISPR gRNA sequence
ttgagagttgcatttagcag

SEQ ID NO: 816576 - DNA, 20 bp, Artificial
  CRISPR gRNA sequence
gagagttgcatttagcagta

SEQ ID NO: 816577 - DNA, 20 bp, Artificial
  CRISPR gRNA sequence
agagttgcatttagcagtat

SEQ ID NO: 816578 - DNA, 20 bp, Artificial
  CRISPR gRNA sequence
catttagcagtatggaggtc

SEQ ID NO: 816579 - DNA, 20 bp, Artificial
  CRISPR gRNA sequence
agcagtatggaggtcatgga

SEQ ID NO: 816580 - DNA, 20 bp, Artificial
  CRISPR gRNA sequence
gcagtatggaggtcatggat

SEQ ID NO: 816581 - DNA, 20 bp, Artificial
  CRISPR gRNA sequence
acaagcacagtatcagtgag

SEQ ID NO: 816582 - DNA, 20 bp, Artificial
  CRISPR gRNA sequence
tgtacagatgaaagcttgaa

SEQ ID NO: 816583 - DNA, 20 bp, Artificial
  CRISPR gRNA sequence
gtacagatgaaagcttgaat

SEQ ID NO: 816584 - DNA, 20 bp, Artificial
  CRISPR gRNA sequence
tacagatgaaagcttgaata

SEQ ID NO: 816585 - DNA, 20 bp, Artificial
  CRISPR gRNA sequence
gaataggttcaaaagagaat

SEQ ID NO: 816586 - DNA, 20 bp, Artificial
  CRISPR gRNA sequence
aataggttcaaaagagaatg

SEQ ID NO: 816587 - DNA, 20 bp, Artificial
  CRISPR gRNA sequence
aaaagagaatgggtaaagat

SEQ ID NO: 816588 - DNA, 20 bp, Artificial
  CRISPR gRNA sequence
tctcaagaagagtgctataa

SEQ ID NO: 816589 - DNA, 20 bp, Artificial
  CRISPR gRNA sequence
tcaagaagagtgctataaaa

SEQ ID NO: 816590 - DNA, 20 bp, Artificial
  CRISPR gRNA sequence
aagaagagtgctataaaaag

SEQ ID NO: 816591 - DNA, 20 bp, Artificial
  CRISPR gRNA sequence
taaaaaggagaagagaaatg

SEQ ID NO: 816592 - DNA, 20 bp, Artificial
  CRISPR gRNA sequence
gagggaaatgtaaggtcctc

SEQ ID NO: 816593 - DNA, 20 bp, Artificial
  CRISPR gRNA sequence
agtgagctgtattcttgttt

SEQ ID NO: 816594 - DNA, 20 bp, Artificial
  CRISPR gRNA sequence
tattcttgtttttattttag

SEQ ID NO: 816595 - DNA, 20 bp, Artificial
  CRISPR gRNA sequence
ttgtttttattttagaaagg

SEQ ID NO: 816596 - DNA, 20 bp, Artificial
  CRISPR gRNA sequence
gtttttattttagaaaggga

SEQ ID NO: 816597 - DNA, 20 bp, Artificial
  CRISPR gRNA sequence
tttttattttagaaagggag

SEQ ID NO: 816598 - DNA, 20 bp, Artificial
  CRISPR gRNA sequence
ttattttagaaagggagatc

SEQ ID NO: 816599 - DNA, 20 bp, Artificial
  CRISPR gRNA sequence
tattttagaaagggagatct

SEQ ID NO: 816600 - DNA, 20 bp, Artificial
  CRISPR gRNA sequence
attttagaaagggagatctt

SEQ ID NO: 816601 - DNA, 20 bp, Artificial
  CRISPR gRNA sequence
ttttagaaagggagatctta

SEQ ID NO: 816602 - DNA, 20 bp, Artificial
  CRISPR gRNA sequence
tagaaagggagatcttacag

SEQ ID NO: 816603 - DNA, 20 bp, Artificial
  CRISPR gRNA sequence
agaaagggagatcttacagc

SEQ ID NO: 816604 - DNA, 20 bp, Artificial
  CRISPR gRNA sequence
gaaagggagatcttacagca

SEQ ID NO: 816605 - DNA, 20 bp, Artificial
  CRISPR gRNA sequence
acagcaggtaacaactggga

SEQ ID NO: 816606 - DNA, 20 bp, Artificial
  CRISPR gRNA sequence
cagcaggtaacaactgggaa

SEQ ID NO: 816607 - DNA, 20 bp, Artificial
  CRISPR gRNA sequence
ggaacagaattaagtgcttt

SEQ ID NO: 816608 - DNA, 20 bp, Artificial
  CRISPR gRNA sequence
agtgctttccacagggaaat

SEQ ID NO: 816609 - DNA, 20 bp, Artificial
  CRISPR gRNA sequence
tccacagggaaatgctcatg

SEQ ID NO: 816610 - DNA, 20 bp, Artificial
  CRISPR gRNA sequence
ccacagggaaatgctcatgg

SEQ ID NO: 816611 - DNA, 20 bp, Artificial
  CRISPR gRNA sequence
cacagggaaatgctcatggc

SEQ ID NO: 816612 - DNA, 20 bp, Artificial
  CRISPR gRNA sequence
atggcataccttagcttgac

SEQ ID NO: 816613 - DNA, 20 bp, Artificial
  CRISPR gRNA sequence
agcttgaccagaagatagcc

SEQ ID NO: 816614 - DNA, 20 bp, Artificial
  CRISPR gRNA sequence
gcttgaccagaagatagcct

SEQ ID NO: 816615 - DNA, 20 bp, Artificial
  CRISPR gRNA sequence
gaccagaagatagccttcct

SEQ ID NO: 816616 - DNA, 20 bp, Artificial
  CRISPR gRNA sequence
accagaagatagccttcctt

SEQ ID NO: 816617 - DNA, 20 bp, Artificial
  CRISPR gRNA sequence
ccttattcagatgcatatat

SEQ ID NO: 816618 - DNA, 20 bp, Artificial
  CRISPR gRNA sequence
cttattcagatgcatatata

SEQ ID NO: 816619 - DNA, 20 bp, Artificial
  CRISPR gRNA sequence
attcagatgcatatatatcc

SEQ ID NO: 816620 - DNA, 20 bp, Artificial
  CRISPR gRNA sequence
ttcagatgcatatatatcca

SEQ ID NO: 816621 - DNA, 20 bp, Artificial
  CRISPR gRNA sequence
agatgcatatatatccaaga

SEQ ID NO: 816622 - DNA, 20 bp, Artificial
  CRISPR gRNA sequence
aagctgcaccaacaggcctg

SEQ ID NO: 816623 - DNA, 20 bp, Artificial
  CRISPR gRNA sequence
agctgcaccaacaggcctgg

SEQ ID NO: 816624 - DNA, 20 bp, Artificial
  CRISPR gRNA sequence
caccaacaggcctggcactt

SEQ ID NO: 816625 - DNA, 20 bp, Artificial
  CRISPR gRNA sequence
gcacttgccagcactcttat

SEQ ID NO: 816626 - DNA, 20 bp, Artificial
  CRISPR gRNA sequence
gccagcactcttatttttag

SEQ ID NO: 816627 - DNA, 20 bp, Artificial
  CRISPR gRNA sequence
ccagcactcttatttttaga

SEQ ID NO: 816628 - DNA, 20 bp, Artificial
  CRISPR gRNA sequence
ttatttttagagcatgaaag

SEQ ID NO: 816629 - DNA, 20 bp, Artificial
  CRISPR gRNA sequence
atttttagagcatgaaagga

SEQ ID NO: 816630 - DNA, 20 bp, Artificial
  CRISPR gRNA sequence
tttttagagcatgaaaggac

SEQ ID NO: 816631 - DNA, 20 bp, Artificial
  CRISPR gRNA sequence
ttagagcatgaaaggacagc

SEQ ID NO: 816632 - DNA, 20 bp, Artificial
  CRISPR gRNA sequence
tagagcatgaaaggacagca

SEQ ID NO: 816633 - DNA, 20 bp, Artificial
  CRISPR gRNA sequence
agagcatgaaaggacagcat

SEQ ID NO: 816634 - DNA, 20 bp, Artificial
  CRISPR gRNA sequence
gagcatgaaaggacagcatg

SEQ ID NO: 816635 - DNA, 20 bp, Artificial
  CRISPR gRNA sequence
tagcaacagaaaagattctt

SEQ ID NO: 816636 - DNA, 20 bp, Artificial
  CRISPR gRNA sequence
gcaacagaaaagattcttgg

SEQ ID NO: 816637 - DNA, 20 bp, Artificial
  CRISPR gRNA sequence
ttggatcacctgccactggc

SEQ ID NO: 816638 - DNA, 20 bp, Artificial
  CRISPR gRNA sequence
ggatcacctgccactggctt

SEQ ID NO: 816639 - DNA, 20 bp, Artificial
  CRISPR gRNA sequence
gatcacctgccactggcttt

SEQ ID NO: 816640 - DNA, 20 bp, Artificial
  CRISPR gRNA sequence
ccactggctttaacttcccc

SEQ ID NO: 816641 - DNA, 20 bp, Artificial
  CRISPR gRNA sequence
gctttaacttccccttcttc

SEQ ID NO: 816642 - DNA, 20 bp, Artificial
  CRISPR gRNA sequence
taacttccccttcttccttg

SEQ ID NO: 816643 - DNA, 20 bp, Artificial
  CRISPR gRNA sequence
aacttccccttcttccttgc

SEQ ID NO: 816644 - DNA, 20 bp, Artificial
  CRISPR gRNA sequence
acttccccttcttccttgcc

SEQ ID NO: 816645 - DNA, 20 bp, Artificial
  CRISPR gRNA sequence
ccccttcttccttgcccttc

SEQ ID NO: 816646 - DNA, 20 bp, Artificial
  CRISPR gRNA sequence
cccttcttccttgcccttcc

SEQ ID NO: 816647 - DNA, 20 bp, Artificial
  CRISPR gRNA sequence
cttccttgcccttccacggg

SEQ ID NO: 816648 - DNA, 20 bp, Artificial
  CRISPR gRNA sequence
ttccttgcccttccacgggg

SEQ ID NO: 816649 - DNA, 20 bp, Artificial
  CRISPR gRNA sequence
ccttgcccttccacggggac

SEQ ID NO: 816650 - DNA, 20 bp, Artificial
  CRISPR gRNA sequence
cttgcccttccacggggact

SEQ ID NO: 816651 - DNA, 20 bp, Artificial
  CRISPR gRNA sequence
gcccttccacggggactttc

SEQ ID NO: 816652 - DNA, 20 bp, Artificial
  CRISPR gRNA sequence
cccttccacggggactttcc

SEQ ID NO: 816653 - DNA, 20 bp, Artificial
  CRISPR gRNA sequence
ccacggggactttcctggca

SEQ ID NO: 816654 - DNA, 20 bp, Artificial
  CRISPR gRNA sequence
cacggggactttcctggcac

SEQ ID NO: 816655 - DNA, 20 bp, Artificial
  CRISPR gRNA sequence
tcctggcacactgtcccctt

SEQ ID NO: 816656 - DNA, 20 bp, Artificial
  CRISPR gRNA sequence
cctggcacactgtccccttg

SEQ ID NO: 816657 - DNA, 20 bp, Artificial
  CRISPR gRNA sequence
ctggcacactgtccccttga

SEQ ID NO: 816658 - DNA, 20 bp, Artificial
  CRISPR gRNA sequence
gcacactgtccccttgagca

SEQ ID NO: 816659 - DNA, 20 bp, Artificial
  CRISPR gRNA sequence
tccccttgagcaaaccgagg

SEQ ID NO: 816660 - DNA, 20 bp, Artificial
  CRISPR gRNA sequence
gagcaaaccgaggaacagac

SEQ ID NO: 816661 - DNA, 20 bp, Artificial
  CRISPR gRNA sequence
agcaaaccgaggaacagaca

SEQ ID NO: 816662 - DNA, 20 bp, Artificial
  CRISPR gRNA sequence
ctataaagatactttccaac

SEQ ID NO: 816663 - DNA, 20 bp, Artificial
  CRISPR gRNA sequence
taaagatactttccaaccag

SEQ ID NO: 816664 - DNA, 20 bp, Artificial
  CRISPR gRNA sequence
tccaaccagcagcttccttt

SEQ ID NO: 816665 - DNA, 20 bp, Artificial
  CRISPR gRNA sequence
ccaaccagcagcttcctttc

SEQ ID NO: 816666 - DNA, 20 bp, Artificial
  CRISPR gRNA sequence
caaccagcagcttcctttcc

SEQ ID NO: 816667 - DNA, 20 bp, Artificial
  CRISPR gRNA sequence
cctttcctactaatcctcct

SEQ ID NO: 816668 - DNA, 20 bp, Artificial
  CRISPR gRNA sequence
ctttcctactaatcctcctc

SEQ ID NO: 816669 - DNA, 20 bp, Artificial
  CRISPR gRNA sequence
tcctactaatcctcctctgg

SEQ ID NO: 816670 - DNA, 20 bp, Artificial
  CRISPR gRNA sequence
cctactaatcctcctctggg

SEQ ID NO: 816671 - DNA, 20 bp, Artificial
  CRISPR gRNA sequence
ctactaatcctcctctgggg

SEQ ID NO: 816672 - DNA, 20 bp, Artificial
  CRISPR gRNA sequence
ctaatcctcctctggggaaa

SEQ ID NO: 816673 - DNA, 20 bp, Artificial
  CRISPR gRNA sequence
atcctcctctggggaaaata

SEQ ID NO: 816674 - DNA, 20 bp, Artificial
  CRISPR gRNA sequence
ctctggggaaaatatggttt

SEQ ID NO: 816675 - DNA, 20 bp, Artificial
  CRISPR gRNA sequence
tggggaaaatatggtttatg

SEQ ID NO: 816676 - DNA, 20 bp, Artificial
  CRISPR gRNA sequence
gggaaaatatggtttatgca

SEQ ID NO: 816677 - DNA, 20 bp, Artificial
  CRISPR gRNA sequence
atgcaatgagtaagagctca

SEQ ID NO: 816678 - DNA, 20 bp, Artificial
  CRISPR gRNA sequence
tgcaatgagtaagagctcag

SEQ ID NO: 816679 - DNA, 20 bp, Artificial
  CRISPR gRNA sequence
aggctctaaaatcagacaca

SEQ ID NO: 816680 - DNA, 20 bp, Artificial
  CRISPR gRNA sequence
taaaatcagacacatctggg

SEQ ID NO: 816681 - DNA, 20 bp, Artificial
  CRISPR gRNA sequence
aaatcagacacatctgggtt

SEQ ID NO: 816682 - DNA, 20 bp, Artificial
  CRISPR gRNA sequence
ggtttaatcctggttttaca

SEQ ID NO: 816683 - DNA, 20 bp, Artificial
  CRISPR gRNA sequence
aatcctggttttacaaattg

SEQ ID NO: 816684 - DNA, 20 bp, Artificial
  CRISPR gRNA sequence
atcctggttttacaaattgt

SEQ ID NO: 816685 - DNA, 20 bp, Artificial
  CRISPR gRNA sequence
gttttacaaattgtaagcct

SEQ ID NO: 816686 - DNA, 20 bp, Artificial
  CRISPR gRNA sequence
tacaaattgtaagcctctaa

SEQ ID NO: 816687 - DNA, 20 bp, Artificial
  CRISPR gRNA sequence
acaaattgtaagcctctaac

SEQ ID NO: 816688 - DNA, 20 bp, Artificial
  CRISPR gRNA sequence
caaattgtaagcctctaaca

SEQ ID NO: 816689 - DNA, 20 bp, Artificial
  CRISPR gRNA sequence
taagcctctaacaccttgga

SEQ ID NO: 816690 - DNA, 20 bp, Artificial
  CRISPR gRNA sequence
taacaccttggacaaatttt

SEQ ID NO: 816691 - DNA, 20 bp, Artificial
  CRISPR gRNA sequence
acaccttggacaaattttga

SEQ ID NO: 816692 - DNA, 20 bp, Artificial
  CRISPR gRNA sequence
ggacaaattttgaaaagtct

SEQ ID NO: 816693 - DNA, 20 bp, Artificial
  CRISPR gRNA sequence
gacaaattttgaaaagtctt

SEQ ID NO: 816694 - DNA, 20 bp, Artificial
  CRISPR gRNA sequence
tgaaaagtctttgtgccttg

SEQ ID NO: 816695 - DNA, 20 bp, Artificial
  CRISPR gRNA sequence
gaaaagtctttgtgccttgt

SEQ ID NO: 816696 - DNA, 20 bp, Artificial
  CRISPR gRNA sequence
aaaagtctttgtgccttgtt

SEQ ID NO: 816697 - DNA, 20 bp, Artificial
  CRISPR gRNA sequence
tgtgccttgttttcctatta

SEQ ID NO: 816698 - DNA, 20 bp, Artificial
  CRISPR gRNA sequence
gtgccttgttttcctattat

SEQ ID NO: 816699 - DNA, 20 bp, Artificial
  CRISPR gRNA sequence
tgccttgttttcctattatg

SEQ ID NO: 816700 - DNA, 20 bp, Artificial
  CRISPR gRNA sequence
gttttcctattatgctaata

SEQ ID NO: 816701 - DNA, 20 bp, Artificial
  CRISPR gRNA sequence
ttttcctattatgctaatag

SEQ ID NO: 816702 - DNA, 20 bp, Artificial
  CRISPR gRNA sequence
tcctattatgctaatagtag

SEQ ID NO: 816703 - DNA, 20 bp, Artificial
  CRISPR gRNA sequence
cctattatgctaatagtagc

SEQ ID NO: 816704 - DNA, 20 bp, Artificial
  CRISPR gRNA sequence
ctattatgctaatagtagca

SEQ ID NO: 816705 - DNA, 20 bp, Artificial
  CRISPR gRNA sequence
ttatgctaatagtagcaaca

SEQ ID NO: 816706 - DNA, 20 bp, Artificial
  CRISPR gRNA sequence
tgctaatagtagcaacaccc

SEQ ID NO: 816707 - DNA, 20 bp, Artificial
  CRISPR gRNA sequence
atagtagcaacacccacctt

SEQ ID NO: 816708 - DNA, 20 bp, Artificial
  CRISPR gRNA sequence
aagctagaatcttagacctc

SEQ ID NO: 816709 - DNA, 20 bp, Artificial
  CRISPR gRNA sequence
agctagaatcttagacctct

SEQ ID NO: 816710 - DNA, 20 bp, Artificial
  CRISPR gRNA sequence
gaatcttagacctctgcatt

SEQ ID NO: 816711 - DNA, 20 bp, Artificial
  CRISPR gRNA sequence
agacctctgcatttctcatc

SEQ ID NO: 816712 - DNA, 20 bp, Artificial
  CRISPR gRNA sequence
gacctctgcatttctcatct

SEQ ID NO: 816713 - DNA, 20 bp, Artificial
  CRISPR gRNA sequence
tgcatttctcatcttgcaaa

SEQ ID NO: 816714 - DNA, 20 bp, Artificial
  CRISPR gRNA sequence
catttctcatcttgcaaata

SEQ ID NO: 816715 - DNA, 20 bp, Artificial
  CRISPR gRNA sequence
ctcatcttgcaaatatggcc

SEQ ID NO: 816716 - DNA, 20 bp, Artificial
  CRISPR gRNA sequence
tcatcttgcaaatatggccc

SEQ ID NO: 816717 - DNA, 20 bp, Artificial
  CRISPR gRNA sequence
atcttgcaaatatggcccat

SEQ ID NO: 816718 - DNA, 20 bp, Artificial
  CRISPR gRNA sequence
gcaaatatggcccatcccct

SEQ ID NO: 816719 - DNA, 20 bp, Artificial
  CRISPR gRNA sequence
caaatatggcccatccccta

SEQ ID NO: 816720 - DNA, 20 bp, Artificial
  CRISPR gRNA sequence
gtcctgttaattctccctcc

SEQ ID NO: 816721 - DNA, 20 bp, Artificial
  CRISPR gRNA sequence
ttaattctccctcctggata

SEQ ID NO: 816722 - DNA, 20 bp, Artificial
  CRISPR gRNA sequence
attctccctcctggatactt

SEQ ID NO: 816723 - DNA, 20 bp, Artificial
  CRISPR gRNA sequence
tccctcctggatactttttg

SEQ ID NO: 816724 - DNA, 20 bp, Artificial
  CRISPR gRNA sequence
cctcctggatactttttgca

SEQ ID NO: 816725 - DNA, 20 bp, Artificial
  CRISPR gRNA sequence
ctggatactttttgcatggt

SEQ ID NO: 816726 - DNA, 20 bp, Artificial
  CRISPR gRNA sequence
gatactttttgcatggtggc

SEQ ID NO: 816727 - DNA, 20 bp, Artificial
  CRISPR gRNA sequence
tttgcatggtggctctcctt

SEQ ID NO: 816728 - DNA, 20 bp, Artificial
  CRISPR gRNA sequence
ttgcatggtggctctccttt

SEQ ID NO: 816729 - DNA, 20 bp, Artificial
  CRISPR gRNA sequence
tgcatggtggctctcctttc

SEQ ID NO: 816730 - DNA, 20 bp, Artificial
  CRISPR gRNA sequence
gcatggtggctctcctttct

SEQ ID NO: 816731 - DNA, 20 bp, Artificial
  CRISPR gRNA sequence
catggtggctctcctttctt

SEQ ID NO: 816732 - DNA, 20 bp, Artificial
  CRISPR gRNA sequence
tcctttcttccaccccactg

SEQ ID NO: 816733 - DNA, 20 bp, Artificial
  CRISPR gRNA sequence
ctttcttccaccccactgcc

SEQ ID NO: 816734 - DNA, 20 bp, Artificial
  CRISPR gRNA sequence
tcttccaccccactgccatc

SEQ ID NO: 816735 - DNA, 20 bp, Artificial
  CRISPR gRNA sequence
cttccaccccactgccatca

SEQ ID NO: 816736 - DNA, 20 bp, Artificial
  CRISPR gRNA sequence
ttccaccccactgccatcac

SEQ ID NO: 816737 - DNA, 20 bp, Artificial
  CRISPR gRNA sequence
ccaccccactgccatcacct

SEQ ID NO: 816738 - DNA, 20 bp, Artificial
  CRISPR gRNA sequence
caccccactgccatcacctt

SEQ ID NO: 816739 - DNA, 20 bp, Artificial
  CRISPR gRNA sequence
ccatcaccttaattcagctt

SEQ ID NO: 816740 - DNA, 20 bp, Artificial
  CRISPR gRNA sequence
aattcagcttcttatcattt

SEQ ID NO: 816741 - DNA, 20 bp, Artificial
  CRISPR gRNA sequence
attcagcttcttatcatttc

SEQ ID NO: 816742 - DNA, 20 bp, Artificial
  CRISPR gRNA sequence
agcttcttatcatttcttct

SEQ ID NO: 816743 - DNA, 20 bp, Artificial
  CRISPR gRNA sequence
cttatcatttcttcttatac

SEQ ID NO: 816744 - DNA, 20 bp, Artificial
  CRISPR gRNA sequence
ttatcatttcttcttatacc

SEQ ID NO: 816745 - DNA, 20 bp, Artificial
  CRISPR gRNA sequence
atcatttcttcttataccat

SEQ ID NO: 816746 - DNA, 20 bp, Artificial
  CRISPR gRNA sequence
tcatttcttcttataccata

SEQ ID NO: 816747 - DNA, 20 bp, Artificial
  CRISPR gRNA sequence
cttcttataccatagcagag

SEQ ID NO: 816748 - DNA, 20 bp, Artificial
  CRISPR gRNA sequence
ttcttataccatagcagagc

SEQ ID NO: 816749 - DNA, 20 bp, Artificial
  CRISPR gRNA sequence
cttataccatagcagagcct

SEQ ID NO: 816750 - DNA, 20 bp, Artificial
  CRISPR gRNA sequence
ttataccatagcagagcctt

SEQ ID NO: 816751 - DNA, 20 bp, Artificial
  CRISPR gRNA sequence
ataccatagcagagccttct

SEQ ID NO: 816752 - DNA, 20 bp, Artificial
  CRISPR gRNA sequence
taccatagcagagccttctc

SEQ ID NO: 816753 - DNA, 20 bp, Artificial
  CRISPR gRNA sequence
ctcactgctatttttacctt

SEQ ID NO: 816754 - DNA, 20 bp, Artificial
  CRISPR gRNA sequence
tcactgctatttttaccttc

SEQ ID NO: 816755 - DNA, 20 bp, Artificial
  CRISPR gRNA sequence
actgctatttttaccttcta

SEQ ID NO: 816756 - DNA, 20 bp, Artificial
  CRISPR gRNA sequence
ctatttttaccttctagtct

SEQ ID NO: 816757 - DNA, 20 bp, Artificial
  CRISPR gRNA sequence
tttttaccttctagtcttgc

SEQ ID NO: 816758 - DNA, 20 bp, Artificial
  CRISPR gRNA sequence
ttaccttctagtcttgcctt

SEQ ID NO: 816759 - DNA, 20 bp, Artificial
  CRISPR gRNA sequence
taccttctagtcttgccttc

SEQ ID NO: 816760 - DNA, 20 bp, Artificial
  CRISPR gRNA sequence
accttctagtcttgccttcc

SEQ ID NO: 816761 - DNA, 20 bp, Artificial
  CRISPR gRNA sequence
ccttctagtcttgccttcct

SEQ ID NO: 816762 - DNA, 20 bp, Artificial
  CRISPR gRNA sequence
ctagtcttgccttcctctgc

SEQ ID NO: 816763 - DNA, 20 bp, Artificial
  CRISPR gRNA sequence
tagtcttgccttcctctgct

SEQ ID NO: 816764 - DNA, 20 bp, Artificial
  CRISPR gRNA sequence
gtcttgccttcctctgctcc

SEQ ID NO: 816765 - DNA, 20 bp, Artificial
  CRISPR gRNA sequence
gccttcctctgctccatcct

SEQ ID NO: 816766 - DNA, 20 bp, Artificial
  CRISPR gRNA sequence
ccttcctctgctccatcctc

SEQ ID NO: 816767 - DNA, 20 bp, Artificial
  CRISPR gRNA sequence
cctctgctccatcctccact

SEQ ID NO: 816768 - DNA, 20 bp, Artificial
  CRISPR gRNA sequence
ctctgctccatcctccactt

SEQ ID NO: 816769 - DNA, 20 bp, Artificial
  CRISPR gRNA sequence
tgctccatcctccacttatt

SEQ ID NO: 816770 - DNA, 20 bp, Artificial
  CRISPR gRNA sequence
ctccatcctccacttattga

SEQ ID NO: 816771 - DNA, 20 bp, Artificial
  CRISPR gRNA sequence
catcctccacttattgaggt

SEQ ID NO: 816772 - DNA, 20 bp, Artificial
  CRISPR gRNA sequence
cacttattgaggtgaaggac

SEQ ID NO: 816773 - DNA, 20 bp, Artificial
  CRISPR gRNA sequence
attgaggtgaaggacaagaa

SEQ ID NO: 816774 - DNA, 20 bp, Artificial
  CRISPR gRNA sequence
ttgaggtgaaggacaagaac

SEQ ID NO: 816775 - DNA, 20 bp, Artificial
  CRISPR gRNA sequence
aggtgaaggacaagaacctt

SEQ ID NO: 816776 - DNA, 20 bp, Artificial
  CRISPR gRNA sequence
ggagtcatcttgagtccttt

SEQ ID NO: 816777 - DNA, 20 bp, Artificial
  CRISPR gRNA sequence
gagtcatcttgagtcctttc

SEQ ID NO: 816778 - DNA, 20 bp, Artificial
  CRISPR gRNA sequence
gagtcctttcttttctcact

SEQ ID NO: 816779 - DNA, 20 bp, Artificial
  CRISPR gRNA sequence
agtcctttcttttctcactc

SEQ ID NO: 816780 - DNA, 20 bp, Artificial
  CRISPR gRNA sequence
tcttttctcactctacatct

SEQ ID NO: 816781 - DNA, 20 bp, Artificial
  CRISPR gRNA sequence
cttttctcactctacatctg

SEQ ID NO: 816782 - DNA, 20 bp, Artificial
  CRISPR gRNA sequence
ttttctcactctacatctga

SEQ ID NO: 816783 - DNA, 20 bp, Artificial
  CRISPR gRNA sequence
ttctcactctacatctgatt

SEQ ID NO: 816784 - DNA, 20 bp, Artificial
  CRISPR gRNA sequence
tctcactctacatctgattc

SEQ ID NO: 816785 - DNA, 20 bp, Artificial
  CRISPR gRNA sequence
ctcactctacatctgattca

SEQ ID NO: 816786 - DNA, 20 bp, Artificial
  CRISPR gRNA sequence
tcactctacatctgattcat

SEQ ID NO: 816787 - DNA, 20 bp, Artificial
  CRISPR gRNA sequence
actctacatctgattcatta

SEQ ID NO: 816788 - DNA, 20 bp, Artificial
  CRISPR gRNA sequence
tacatctgattcattaacca

SEQ ID NO: 816789 - DNA, 20 bp, Artificial
  CRISPR gRNA sequence
catctgattcattaaccaac

SEQ ID NO: 816790 - DNA, 20 bp, Artificial
  CRISPR gRNA sequence
attcattaaccaaccctatt

SEQ ID NO: 816791 - DNA, 20 bp, Artificial
  CRISPR gRNA sequence
attaaccaaccctattggcc

SEQ ID NO: 816792 - DNA, 20 bp, Artificial
  CRISPR gRNA sequence
accaaccctattggcccttc

SEQ ID NO: 816793 - DNA, 20 bp, Artificial
  CRISPR gRNA sequence
ttggcccttccttcaaatat

SEQ ID NO: 816794 - DNA, 20 bp, Artificial
  CRISPR gRNA sequence
gcccttccttcaaatatatc

SEQ ID NO: 816795 - DNA, 20 bp, Artificial
  CRISPR gRNA sequence
ccttcaaatatatccagaat

SEQ ID NO: 816796 - DNA, 20 bp, Artificial
  CRISPR gRNA sequence
cttcaaatatatccagaatc

SEQ ID NO: 816797 - DNA, 20 bp, Artificial
  CRISPR gRNA sequence
caaatatatccagaatctga

SEQ ID NO: 816798 - DNA, 20 bp, Artificial
  CRISPR gRNA sequence
aaatatatccagaatctgac

SEQ ID NO: 816799 - DNA, 20 bp, Artificial
  CRISPR gRNA sequence
accatttctcaccacctcca

SEQ ID NO: 816800 - DNA, 20 bp, Artificial
  CRISPR gRNA sequence
ctcaccacctccactgcttc

SEQ ID NO: 816801 - DNA, 20 bp, Artificial
  CRISPR gRNA sequence
tcaccacctccactgcttcc

SEQ ID NO: 816802 - DNA, 20 bp, Artificial
  CRISPR gRNA sequence
accacctccactgcttccat

SEQ ID NO: 816803 - DNA, 20 bp, Artificial
  CRISPR gRNA sequence
cactgcttccatatcggtca

SEQ ID NO: 816804 - DNA, 20 bp, Artificial
  CRISPR gRNA sequence
cttccatatcggtcagagtc

SEQ ID NO: 816805 - DNA, 20 bp, Artificial
  CRISPR gRNA sequence
ccatatcggtcagagtcatt

SEQ ID NO: 816806 - DNA, 20 bp, Artificial
  CRISPR gRNA sequence
catatcggtcagagtcattg

SEQ ID NO: 816807 - DNA, 20 bp, Artificial
  CRISPR gRNA sequence
tcatttctcatggtgatttc

SEQ ID NO: 816808 - DNA, 20 bp, Artificial
  CRISPR gRNA sequence
ctcatggtgatttctgcatt

SEQ ID NO: 816809 - DNA, 20 bp, Artificial
  CRISPR gRNA sequence
tcatggtgatttctgcatta

SEQ ID NO: 816810 - DNA, 20 bp, Artificial
  CRISPR gRNA sequence
atggtgatttctgcattagt

SEQ ID NO: 816811 - DNA, 20 bp, Artificial
  CRISPR gRNA sequence
ctgcattagtctgacaactg

SEQ ID NO: 816812 - DNA, 20 bp, Artificial
  CRISPR gRNA sequence
tgcattagtctgacaactgg

SEQ ID NO: 816813 - DNA, 20 bp, Artificial
  CRISPR gRNA sequence
cattagtctgacaactggat

SEQ ID NO: 816814 - DNA, 20 bp, Artificial
  CRISPR gRNA sequence
gtctgacaactggatgctat

SEQ ID NO: 816815 - DNA, 20 bp, Artificial
  CRISPR gRNA sequence
acaactggatgctatgattc

SEQ ID NO: 816816 - DNA, 20 bp, Artificial
  CRISPR gRNA sequence
gatgctatgattccagtttt

SEQ ID NO: 816817 - DNA, 20 bp, Artificial
  CRISPR gRNA sequence
tgattccagttttgccttcc

SEQ ID NO: 816818 - DNA, 20 bp, Artificial
  CRISPR gRNA sequence
cagttttgccttcctgcagt

SEQ ID NO: 816819 - DNA, 20 bp, Artificial
  CRISPR gRNA sequence
tgccttcctgcagttgattc

SEQ ID NO: 816820 - DNA, 20 bp, Artificial
  CRISPR gRNA sequence
gccttcctgcagttgattct

SEQ ID NO: 816821 - DNA, 20 bp, Artificial
  CRISPR gRNA sequence
ccttcctgcagttgattctg

SEQ ID NO: 816822 - DNA, 20 bp, Artificial
  CRISPR gRNA sequence
cctgcagttgattctgcagc

SEQ ID NO: 816823 - DNA, 20 bp, Artificial
  CRISPR gRNA sequence
ctgcagttgattctgcagcc

SEQ ID NO: 816824 - DNA, 20 bp, Artificial
  CRISPR gRNA sequence
cagttgattctgcagccaga

SEQ ID NO: 816825 - DNA, 20 bp, Artificial
  CRISPR gRNA sequence
attctgcagccagagtggtt

SEQ ID NO: 816826 - DNA, 20 bp, Artificial
  CRISPR gRNA sequence
tgcagccagagtggttttta

SEQ ID NO: 816827 - DNA, 20 bp, Artificial
  CRISPR gRNA sequence
cagccagagtggtttttaaa

SEQ ID NO: 816828 - DNA, 20 bp, Artificial
  CRISPR gRNA sequence
ttaaaaaataaaagtcaaac

SEQ ID NO: 816829 - DNA, 20 bp, Artificial
  CRISPR gRNA sequence
taaaaaataaaagtcaaacc

SEQ ID NO: 816830 - DNA, 20 bp, Artificial
  CRISPR gRNA sequence
aaaaaataaaagtcaaacca

SEQ ID NO: 816831 - DNA, 20 bp, Artificial
  CRISPR gRNA sequence
aaaaataaaagtcaaaccat

SEQ ID NO: 816832 - DNA, 20 bp, Artificial
  CRISPR gRNA sequence
tcttaaaaccttccgatggc

SEQ ID NO: 816833 - DNA, 20 bp, Artificial
  CRISPR gRNA sequence
cttaaaaccttccgatggct

SEQ ID NO: 816834 - DNA, 20 bp, Artificial
  CRISPR gRNA sequence
ttaaaaccttccgatggctc

SEQ ID NO: 816835 - DNA, 20 bp, Artificial
  CRISPR gRNA sequence
aaaaccttccgatggctcag

SEQ ID NO: 816836 - DNA, 20 bp, Artificial
  CRISPR gRNA sequence
aaaccttccgatggctcagc

SEQ ID NO: 816837 - DNA, 20 bp, Artificial
  CRISPR gRNA sequence
ccgatggctcagcatttcac

SEQ ID NO: 816838 - DNA, 20 bp, Artificial
  CRISPR gRNA sequence
cgatggctcagcatttcact

SEQ ID NO: 816839 - DNA, 20 bp, Artificial
  CRISPR gRNA sequence
agcatttcactcagtgtaaa

SEQ ID NO: 816840 - DNA, 20 bp, Artificial
  CRISPR gRNA sequence
cactcagtgtaaaacccagt

SEQ ID NO: 816841 - DNA, 20 bp, Artificial
  CRISPR gRNA sequence
actcagtgtaaaacccagtt

SEQ ID NO: 816842 - DNA, 20 bp, Artificial
  CRISPR gRNA sequence
agtgtaaaacccagtttttt

SEQ ID NO: 816843 - DNA, 20 bp, Artificial
  CRISPR gRNA sequence
tttcaacagccaagacaaga

SEQ ID NO: 816844 - DNA, 20 bp, Artificial
  CRISPR gRNA sequence
ttcaacagccaagacaagag

SEQ ID NO: 816845 - DNA, 20 bp, Artificial
  CRISPR gRNA sequence
tcaacagccaagacaagagg

SEQ ID NO: 816846 - DNA, 20 bp, Artificial
  CRISPR gRNA sequence
caacagccaagacaagaggc

SEQ ID NO: 816847 - DNA, 20 bp, Artificial
  CRISPR gRNA sequence
aacagccaagacaagaggcc

SEQ ID NO: 816848 - DNA, 20 bp, Artificial
  CRISPR gRNA sequence
tcctggaccccatgctttaa

SEQ ID NO: 816849 - DNA, 20 bp, Artificial
  CRISPR gRNA sequence
gaccccatgctttaaaggac

SEQ ID NO: 816850 - DNA, 20 bp, Artificial
  CRISPR gRNA sequence
taaaggacccactgtgccca

SEQ ID NO: 816851 - DNA, 20 bp, Artificial
  CRISPR gRNA sequence
aaaggacccactgtgcccat

SEQ ID NO: 816852 - DNA, 20 bp, Artificial
  CRISPR gRNA sequence
aaggacccactgtgcccatc

SEQ ID NO: 816853 - DNA, 20 bp, Artificial
  CRISPR gRNA sequence
tgcccatccttctccccgag

SEQ ID NO: 816854 - DNA, 20 bp, Artificial
  CRISPR gRNA sequence
ctccccgagagtaaggtgtt

SEQ ID NO: 816855 - DNA, 20 bp, Artificial
  CRISPR gRNA sequence
tccccgagagtaaggtgttc

SEQ ID NO: 816856 - DNA, 20 bp, Artificial
  CRISPR gRNA sequence
cccgagagtaaggtgttcgc

SEQ ID NO: 816857 - DNA, 20 bp, Artificial
  CRISPR gRNA sequence
gcagggctgagagatgttat

SEQ ID NO: 816858 - DNA, 20 bp, Artificial
  CRISPR gRNA sequence
agagatgttatctggagctt

SEQ ID NO: 816859 - DNA, 20 bp, Artificial
  CRISPR gRNA sequence
tctggagcttttgacctacc

SEQ ID NO: 816860 - DNA, 20 bp, Artificial
  CRISPR gRNA sequence
gagcttttgacctaccaacc

SEQ ID NO: 816861 - DNA, 20 bp, Artificial
  CRISPR gRNA sequence
ttgacctaccaaccgccatc

SEQ ID NO: 816862 - DNA, 20 bp, Artificial
  CRISPR gRNA sequence
tgacctaccaaccgccatcc

SEQ ID NO: 816863 - DNA, 20 bp, Artificial
  CRISPR gRNA sequence
gacctaccaaccgccatcca

SEQ ID NO: 816864 - DNA, 20 bp, Artificial
  CRISPR gRNA sequence
acctaccaaccgccatccat

SEQ ID NO: 816865 - DNA, 20 bp, Artificial
  CRISPR gRNA sequence
ccaaccgccatccattgcag

SEQ ID NO: 816866 - DNA, 20 bp, Artificial
  CRISPR gRNA sequence
cagtctgtctttgaaacact

SEQ ID NO: 816867 - DNA, 20 bp, Artificial
  CRISPR gRNA sequence
tctttgaaacactggaattc

SEQ ID NO: 816868 - DNA, 20 bp, Artificial
  CRISPR gRNA sequence
tgaaacactggaattcctag

SEQ ID NO: 816869 - DNA, 20 bp, Artificial
  CRISPR gRNA sequence
gaaacactggaattcctagc

SEQ ID NO: 816870 - DNA, 20 bp, Artificial
  CRISPR gRNA sequence
aaacactggaattcctagcc

SEQ ID NO: 816871 - DNA, 20 bp, Artificial
  CRISPR gRNA sequence
gaattcctagcctgaatggc

SEQ ID NO: 816872 - DNA, 20 bp, Artificial
  CRISPR gRNA sequence
ctagcctgaatggccttaag

SEQ ID NO: 816873 - DNA, 20 bp, Artificial
  CRISPR gRNA sequence
gcctgaatggccttaagcct

SEQ ID NO: 816874 - DNA, 20 bp, Artificial
  CRISPR gRNA sequence
aatggccttaagcctgcttc

SEQ ID NO: 816875 - DNA, 20 bp, Artificial
  CRISPR gRNA sequence
aagcctgcttccaggcctgt

SEQ ID NO: 816876 - DNA, 20 bp, Artificial
  CRISPR gRNA sequence
agcctgcttccaggcctgtg

SEQ ID NO: 816877 - DNA, 20 bp, Artificial
  CRISPR gRNA sequence
cttccaggcctgtgtggcct

SEQ ID NO: 816878 - DNA, 20 bp, Artificial
  CRISPR gRNA sequence
ccaggcctgtgtggcctctt

SEQ ID NO: 816879 - DNA, 20 bp, Artificial
  CRISPR gRNA sequence
caggcctgtgtggcctcttc

SEQ ID NO: 816880 - DNA, 20 bp, Artificial
  CRISPR gRNA sequence
tgtggcctcttccgcagatc

SEQ ID NO: 816881 - DNA, 20 bp, Artificial
  CRISPR gRNA sequence
ttccgcagatccaatcccta

SEQ ID NO: 816882 - DNA, 20 bp, Artificial
  CRISPR gRNA sequence
ccgcagatccaatccctaag

SEQ ID NO: 816883 - DNA, 20 bp, Artificial
  CRISPR gRNA sequence
cgcagatccaatccctaagg

SEQ ID NO: 816884 - DNA, 20 bp, Artificial
  CRISPR gRNA sequence
agggaagaccttgctgccag

SEQ ID NO: 816885 - DNA, 20 bp, Artificial
  CRISPR gRNA sequence
gctgccagtgtacatgtccc

SEQ ID NO: 816886 - DNA, 20 bp, Artificial
  CRISPR gRNA sequence
ctgccagtgtacatgtccct

SEQ ID NO: 816887 - DNA, 20 bp, Artificial
  CRISPR gRNA sequence
ccagtgtacatgtccctcta

SEQ ID NO: 816888 - DNA, 20 bp, Artificial
  CRISPR gRNA sequence
tacccggacactttcattgt

SEQ ID NO: 816889 - DNA, 20 bp, Artificial
  CRISPR gRNA sequence
cccggacactttcattgttt

SEQ ID NO: 816890 - DNA, 20 bp, Artificial
  CRISPR gRNA sequence
tcattgttttttctcctgag

SEQ ID NO: 816891 - DNA, 20 bp, Artificial
  CRISPR gRNA sequence
cattgttttttctcctgaga

SEQ ID NO: 816892 - DNA, 20 bp, Artificial
  CRISPR gRNA sequence
attgttttttctcctgagac

SEQ ID NO: 816893 - DNA, 20 bp, Artificial
  CRISPR gRNA sequence
ttttttctcctgagactgtc

SEQ ID NO: 816894 - DNA, 20 bp, Artificial
  CRISPR gRNA sequence
tttctcctgagactgtctta

SEQ ID NO: 816895 - DNA, 20 bp, Artificial
  CRISPR gRNA sequence
ttctcctgagactgtcttat

SEQ ID NO: 816896 - DNA, 20 bp, Artificial
  CRISPR gRNA sequence
tctcctgagactgtcttatg

SEQ ID NO: 816897 - DNA, 20 bp, Artificial
  CRISPR gRNA sequence
ctcctgagactgtcttatgt

SEQ ID NO: 816898 - DNA, 20 bp, Artificial
  CRISPR gRNA sequence
tcctgagactgtcttatgta

SEQ ID NO: 816899 - DNA, 20 bp, Artificial
  CRISPR gRNA sequence
ctgagactgtcttatgtaaa

SEQ ID NO: 816900 - DNA, 20 bp, Artificial
  CRISPR gRNA sequence
agactgtcttatgtaaaatt

SEQ ID NO: 816901 - DNA, 20 bp, Artificial
  CRISPR gRNA sequence
tcttatgtaaaattgcaaga

SEQ ID NO: 816902 - DNA, 20 bp, Artificial
  CRISPR gRNA sequence
atgtaaaattgcaagagcac

SEQ ID NO: 816903 - DNA, 20 bp, Artificial
  CRISPR gRNA sequence
tgtaaaattgcaagagcact

SEQ ID NO: 816904 - DNA, 20 bp, Artificial
  CRISPR gRNA sequence
caagagcactccaaccctac

SEQ ID NO: 816905 - DNA, 20 bp, Artificial
  CRISPR gRNA sequence
caaccctaccccagcattcc

SEQ ID NO: 816906 - DNA, 20 bp, Artificial
  CRISPR gRNA sequence
ccccagcattcccaacaatc

SEQ ID NO: 816907 - DNA, 20 bp, Artificial
  CRISPR gRNA sequence
ccaacaatccttagtcatct

SEQ ID NO: 816908 - DNA, 20 bp, Artificial
  CRISPR gRNA sequence
agtcatcttttctcccccaa

SEQ ID NO: 816909 - DNA, 20 bp, Artificial
  CRISPR gRNA sequence
gtcatcttttctcccccaaa

SEQ ID NO: 816910 - DNA, 20 bp, Artificial
  CRISPR gRNA sequence
ttctcccccaaagcagtcat

SEQ ID NO: 816911 - DNA, 20 bp, Artificial
  CRISPR gRNA sequence
tctcccccaaagcagtcatt

SEQ ID NO: 816912 - DNA, 20 bp, Artificial
  CRISPR gRNA sequence
ctcccccaaagcagtcatta

SEQ ID NO: 816913 - DNA, 20 bp, Artificial
  CRISPR gRNA sequence
tcccccaaagcagtcattac

SEQ ID NO: 816914 - DNA, 20 bp, Artificial
  CRISPR gRNA sequence
ccccaaagcagtcattacca

SEQ ID NO: 816915 - DNA, 20 bp, Artificial
  CRISPR gRNA sequence
ccatttaacataccatatag

SEQ ID NO: 816916 - DNA, 20 bp, Artificial
  CRISPR gRNA sequence
aacataccatataggtctct

SEQ ID NO: 816917 - DNA, 20 bp, Artificial
  CRISPR gRNA sequence
acataccatataggtctctt

SEQ ID NO: 816918 - DNA, 20 bp, Artificial
  CRISPR gRNA sequence
tttctgttgcccaggctgga

SEQ ID NO: 816919 - DNA, 20 bp, Artificial
  CRISPR gRNA sequence
tctgttgcccaggctggagt

SEQ ID NO: 816920 - DNA, 20 bp, Artificial
  CRISPR gRNA sequence
ctgttgcccaggctggagtc

SEQ ID NO: 816921 - DNA, 20 bp, Artificial
  CRISPR gRNA sequence
tgttgcccaggctggagtca

SEQ ID NO: 816922 - DNA, 20 bp, Artificial
  CRISPR gRNA sequence
ttgcccaggctggagtcagt

SEQ ID NO: 816923 - DNA, 20 bp, Artificial
  CRISPR gRNA sequence
cccaggctggagtcagtggc

SEQ ID NO: 816924 - DNA, 20 bp, Artificial
  CRISPR gRNA sequence
gagtcagtggcacaatcata

SEQ ID NO: 816925 - DNA, 20 bp, Artificial
  CRISPR gRNA sequence
acagtgatggcagcagctgc

SEQ ID NO: 816926 - DNA, 20 bp, Artificial
  CRISPR gRNA sequence
cccgtttagagcagctgcag

SEQ ID NO: 816927 - DNA, 20 bp, Artificial
  CRISPR gRNA sequence
agagcagctgcagcagtgga

SEQ ID NO: 816928 - DNA, 20 bp, Artificial
  CRISPR gRNA sequence
gagcagctgcagcagtggag

SEQ ID NO: 816929 - DNA, 20 bp, Artificial
  CRISPR gRNA sequence
cagcagtggaggtgtggcca

SEQ ID NO: 816930 - DNA, 20 bp, Artificial
  CRISPR gRNA sequence
agttggcggggtgggaaccg

SEQ ID NO: 816931 - DNA, 20 bp, Artificial
  CRISPR gRNA sequence
gcggggtgggaaccgcatgc

SEQ ID NO: 816932 - DNA, 20 bp, Artificial
  CRISPR gRNA sequence
ccaggcacccctgtagctgc

SEQ ID NO: 816933 - DNA, 20 bp, Artificial
  CRISPR gRNA sequence
tagctgcccagcagtggctc

SEQ ID NO: 816934 - DNA, 20 bp, Artificial
  CRISPR gRNA sequence
cccagcagtggctctggacc

SEQ ID NO: 816935 - DNA, 20 bp, Artificial
  CRISPR gRNA sequence
tggacccaggcatctctgta

SEQ ID NO: 816936 - DNA, 20 bp, Artificial
  CRISPR gRNA sequence
gacccaggcatctctgtact

SEQ ID NO: 816937 - DNA, 20 bp, Artificial
  CRISPR gRNA sequence
tgtactctcaggggcccagg

SEQ ID NO: 816938 - DNA, 20 bp, Artificial
  CRISPR gRNA sequence
tactctcaggggcccaggaa

SEQ ID NO: 816939 - DNA, 20 bp, Artificial
  CRISPR gRNA sequence
tcaggggcccaggaagtccc

SEQ ID NO: 816940 - DNA, 20 bp, Artificial
  CRISPR gRNA sequence
aggggcccaggaagtcccct

SEQ ID NO: 816941 - DNA, 20 bp, Artificial
  CRISPR gRNA sequence
ctcccacaaggttgaaagtg

SEQ ID NO: 816942 - DNA, 20 bp, Artificial
  CRISPR gRNA sequence
ccacaaggttgaaagtgcct

SEQ ID NO: 816943 - DNA, 20 bp, Artificial
  CRISPR gRNA sequence
aaagtgcctgctcccactcc

SEQ ID NO: 816944 - DNA, 20 bp, Artificial
  CRISPR gRNA sequence
ctcccactccctggcctctt

SEQ ID NO: 816945 - DNA, 20 bp, Artificial
  CRISPR gRNA sequence
ccactccctggcctcttccc

SEQ ID NO: 816946 - DNA, 20 bp, Artificial
  CRISPR gRNA sequence
cctggcctcttcccactcct

SEQ ID NO: 816947 - DNA, 20 bp, Artificial
  CRISPR gRNA sequence
gcctcttcccactcctggca

SEQ ID NO: 816948 - DNA, 20 bp, Artificial
  CRISPR gRNA sequence
ttcccactcctggcacctgc

SEQ ID NO: 816949 - DNA, 20 bp, Artificial
  CRISPR gRNA sequence
cccactcctggcacctgcta

SEQ ID NO: 816950 - DNA, 20 bp, Artificial
  CRISPR gRNA sequence
ccactcctggcacctgctac

SEQ ID NO: 816951 - DNA, 20 bp, Artificial
  CRISPR gRNA sequence
ctggcacctgctactgggtg

SEQ ID NO: 816952 - DNA, 20 bp, Artificial
  CRISPR gRNA sequence
gcacctgctactgggtgaag

SEQ ID NO: 816953 - DNA, 20 bp, Artificial
  CRISPR gRNA sequence
ctactgggtgaagcaaagtt

SEQ ID NO: 816954 - DNA, 20 bp, Artificial
  CRISPR gRNA sequence
ctgggtgaagcaaagttgtg

SEQ ID NO: 816955 - DNA, 20 bp, Artificial
  CRISPR gRNA sequence
ggtgaagcaaagttgtggcc

SEQ ID NO: 816956 - DNA, 20 bp, Artificial
  CRISPR gRNA sequence
tggccaagcctaggtgctgt

SEQ ID NO: 816957 - DNA, 20 bp, Artificial
  CRISPR gRNA sequence
ggtgctgtcacaacccggcc

SEQ ID NO: 816958 - DNA, 20 bp, Artificial
  CRISPR gRNA sequence
tcacaacccggccaggcatg

SEQ ID NO: 816959 - DNA, 20 bp, Artificial
  CRISPR gRNA sequence
aggatggtactgacacacta

SEQ ID NO: 816960 - DNA, 20 bp, Artificial
  CRISPR gRNA sequence
acacactagccccctgctgc

SEQ ID NO: 816961 - DNA, 20 bp, Artificial
  CRISPR gRNA sequence
gccccctgctgcctcgacct

SEQ ID NO: 816962 - DNA, 20 bp, Artificial
  CRISPR gRNA sequence
ctgcctcgacctcttccaga

SEQ ID NO: 816963 - DNA, 20 bp, Artificial
  CRISPR gRNA sequence
cctcgacctcttccagatgt

SEQ ID NO: 816964 - DNA, 20 bp, Artificial
  CRISPR gRNA sequence
gacctcttccagatgttggg

SEQ ID NO: 816965 - DNA, 20 bp, Artificial
  CRISPR gRNA sequence
ttccagatgttgggtgctga

SEQ ID NO: 816966 - DNA, 20 bp, Artificial
  CRISPR gRNA sequence
ccagatgttgggtgctgaca

SEQ ID NO: 816967 - DNA, 20 bp, Artificial
  CRISPR gRNA sequence
cagatgttgggtgctgacaa

SEQ ID NO: 816968 - DNA, 20 bp, Artificial
  CRISPR gRNA sequence
ggtgctgacaagcacagagg

SEQ ID NO: 816969 - DNA, 20 bp, Artificial
  CRISPR gRNA sequence
acaagcacagagggaggctg

SEQ ID NO: 816970 - DNA, 20 bp, Artificial
  CRISPR gRNA sequence
agcaggggctgagggtggct

SEQ ID NO: 816971 - DNA, 20 bp, Artificial
  CRISPR gRNA sequence
agggtggctcagggcaggcc

SEQ ID NO: 816972 - DNA, 20 bp, Artificial
  CRISPR gRNA sequence
agggcaggcctgcaggcacc

SEQ ID NO: 816973 - DNA, 20 bp, Artificial
  CRISPR gRNA sequence
caggcacccctcggcacgaa

SEQ ID NO: 816974 - DNA, 20 bp, Artificial
  CRISPR gRNA sequence
ggcacgaacagcctgggcat

SEQ ID NO: 816975 - DNA, 20 bp, Artificial
  CRISPR gRNA sequence
ggcatcatggacagcatgtt

SEQ ID NO: 816976 - DNA, 20 bp, Artificial
  CRISPR gRNA sequence
atggcaagagggagacaggt

SEQ ID NO: 816977 - DNA, 20 bp, Artificial
  CRISPR gRNA sequence
cttggcggaaaggggttagg

SEQ ID NO: 816978 - DNA, 20 bp, Artificial
  CRISPR gRNA sequence
ggcggaaaggggttaggtcc

SEQ ID NO: 816979 - DNA, 20 bp, Artificial
  CRISPR gRNA sequence
gcggaaaggggttaggtccc

SEQ ID NO: 816980 - DNA, 20 bp, Artificial
  CRISPR gRNA sequence
ggtccctggtgaaacccaac

SEQ ID NO: 816981 - DNA, 20 bp, Artificial
  CRISPR gRNA sequence
gtgaaacccaaccttcaagc

SEQ ID NO: 816982 - DNA, 20 bp, Artificial
  CRISPR gRNA sequence
caagccagggatggcccaaa

SEQ ID NO: 816983 - DNA, 20 bp, Artificial
  CRISPR gRNA sequence
aagccagggatggcccaaag

SEQ ID NO: 816984 - DNA, 20 bp, Artificial
  CRISPR gRNA sequence
ggagccaggttgccaattgt

SEQ ID NO: 816985 - DNA, 20 bp, Artificial
  CRISPR gRNA sequence
ccaattgtgggtggagtcca

SEQ ID NO: 816986 - DNA, 20 bp, Artificial
  CRISPR gRNA sequence
tgggtggagtccacagcctg

SEQ ID NO: 816987 - DNA, 20 bp, Artificial
  CRISPR gRNA sequence
gggtaagaacttacagtgct

SEQ ID NO: 816988 - DNA, 20 bp, Artificial
  CRISPR gRNA sequence
acagtgctttttctgggccc

SEQ ID NO: 816989 - DNA, 20 bp, Artificial
  CRISPR gRNA sequence
cagtgctttttctgggccct

SEQ ID NO: 816990 - DNA, 20 bp, Artificial
  CRISPR gRNA sequence
tttctgggcccttccatggc

SEQ ID NO: 816991 - DNA, 20 bp, Artificial
  CRISPR gRNA sequence
ttctgggcccttccatggct

SEQ ID NO: 816992 - DNA, 20 bp, Artificial
  CRISPR gRNA sequence
tctgggcccttccatggctg

SEQ ID NO: 816993 - DNA, 20 bp, Artificial
  CRISPR gRNA sequence
ctgggcccttccatggctgc

SEQ ID NO: 816994 - DNA, 20 bp, Artificial
  CRISPR gRNA sequence
tgggcccttccatggctgcc

SEQ ID NO: 816995 - DNA, 20 bp, Artificial
  CRISPR gRNA sequence
ggcccttccatggctgccca

SEQ ID NO: 816996 - DNA, 20 bp, Artificial
  CRISPR gRNA sequence
ccatggctgcccatgggcca

SEQ ID NO: 816997 - DNA, 20 bp, Artificial
  CRISPR gRNA sequence
catggctgcccatgggccaa

SEQ ID NO: 816998 - DNA, 20 bp, Artificial
  CRISPR gRNA sequence
cccatgggccaatcagcaca

SEQ ID NO: 816999 - DNA, 20 bp, Artificial
  CRISPR gRNA sequence
ttcctcccttctgagcctgt

SEQ ID NO: 817000 - DNA, 20 bp, Artificial
  CRISPR gRNA sequence
cctcccttctgagcctgtaa

SEQ ID NO: 817001 - DNA, 20 bp, Artificial
  CRISPR gRNA sequence
ctcccttctgagcctgtaaa

SEQ ID NO: 817002 - DNA, 20 bp, Artificial
  CRISPR gRNA sequence
ccttctgagcctgtaaaaac

SEQ ID NO: 817003 - DNA, 20 bp, Artificial
  CRISPR gRNA sequence
ctgagcctgtaaaaaccctg

SEQ ID NO: 817004 - DNA, 20 bp, Artificial
  CRISPR gRNA sequence
tgagcctgtaaaaaccctgg

SEQ ID NO: 817005 - DNA, 20 bp, Artificial
  CRISPR gRNA sequence
agcctgtaaaaaccctggac

SEQ ID NO: 817006 - DNA, 20 bp, Artificial
  CRISPR gRNA sequence
taaaaaccctggactcgacc

SEQ ID NO: 817007 - DNA, 20 bp, Artificial
  CRISPR gRNA sequence
gactcgaccgggctcagtgg

SEQ ID NO: 817008 - DNA, 20 bp, Artificial
  CRISPR gRNA sequence
gaccgggctcagtggctcat

SEQ ID NO: 817009 - DNA, 20 bp, Artificial
  CRISPR gRNA sequence
agtggctcatgcctgtaatc

SEQ ID NO: 817010 - DNA, 20 bp, Artificial
  CRISPR gRNA sequence
atgcctgtaatcccagcact

SEQ ID NO: 817011 - DNA, 20 bp, Artificial
  CRISPR gRNA sequence
taatcccagcacttgggagg

SEQ ID NO: 817012 - DNA, 20 bp, Artificial
  CRISPR gRNA sequence
gggaggccgaggcaggaaaa

SEQ ID NO: 817013 - DNA, 20 bp, Artificial
  CRISPR gRNA sequence
ggaggccgaggcaggaaaat

SEQ ID NO: 817014 - DNA, 20 bp, Artificial
  CRISPR gRNA sequence
gagaccagcctggccaacat

SEQ ID NO: 817015 - DNA, 20 bp, Artificial
  CRISPR gRNA sequence
agaccagcctggccaacatg

SEQ ID NO: 817016 - DNA, 20 bp, Artificial
  CRISPR gRNA sequence
gccaacatggcgaaaccccg

SEQ ID NO: 817017 - DNA, 20 bp, Artificial
  CRISPR gRNA sequence
tactaaaaatacaaaaaatt

SEQ ID NO: 817018 - DNA, 20 bp, Artificial
  CRISPR gRNA sequence
ctaaaaatacaaaaaattag

SEQ ID NO: 817019 - DNA, 20 bp, Artificial
  CRISPR gRNA sequence
aaaatacaaaaaattagctg

SEQ ID NO: 817020 - DNA, 20 bp, Artificial
  CRISPR gRNA sequence
gctggatgtagtggtgggtg

SEQ ID NO: 817021 - DNA, 20 bp, Artificial
  CRISPR gRNA sequence
gatgtagtggtgggtgtctg

SEQ ID NO: 817022 - DNA, 20 bp, Artificial
  CRISPR gRNA sequence
taataccagctactcgggag

SEQ ID NO: 817023 - DNA, 20 bp, Artificial
  CRISPR gRNA sequence
ctcgggaggctgaagcagga

SEQ ID NO: 817024 - DNA, 20 bp, Artificial
  CRISPR gRNA sequence
gggaggctgaagcaggagaa

SEQ ID NO: 817025 - DNA, 20 bp, Artificial
  CRISPR gRNA sequence
aagcaggagaatcgcttgaa

SEQ ID NO: 817026 - DNA, 20 bp, Artificial
  CRISPR gRNA sequence
gaacccgggaggcagaggtt

SEQ ID NO: 817027 - DNA, 20 bp, Artificial
  CRISPR gRNA sequence
aacccgggaggcagaggttg

SEQ ID NO: 817028 - DNA, 20 bp, Artificial
  CRISPR gRNA sequence
cagtgagccgagattgcgcc

SEQ ID NO: 817029 - DNA, 20 bp, Artificial
  CRISPR gRNA sequence
cgccactgcactccagccct

SEQ ID NO: 817030 - DNA, 20 bp, Artificial
  CRISPR gRNA sequence
cactccagccctggtgacag

SEQ ID NO: 817031 - DNA, 20 bp, Artificial
  CRISPR gRNA sequence
cagccctggtgacagagtga

SEQ ID NO: 817032 - DNA, 20 bp, Artificial
  CRISPR gRNA sequence
gtgacagagtgagactccgt

SEQ ID NO: 817033 - DNA, 20 bp, Artificial
  CRISPR gRNA sequence
cgtctcaaaaaaacaaaaca

SEQ ID NO: 817034 - DNA, 20 bp, Artificial
  CRISPR gRNA sequence
aaaaaaacaaaacaaacaaa

SEQ ID NO: 817035 - DNA, 20 bp, Artificial
  CRISPR gRNA sequence
gactcagccagacttgaaca

SEQ ID NO: 817036 - DNA, 20 bp, Artificial
  CRISPR gRNA sequence
agccagacttgaacagacat

SEQ ID NO: 817037 - DNA, 20 bp, Artificial
  CRISPR gRNA sequence
gaacagacattgggactacc

SEQ ID NO: 817038 - DNA, 20 bp, Artificial
  CRISPR gRNA sequence
aacagacattgggactacca

SEQ ID NO: 817039 - DNA, 20 bp, Artificial
  CRISPR gRNA sequence
ggactaccagctaggggaag

SEQ ID NO: 817040 - DNA, 20 bp, Artificial
  CRISPR gRNA sequence
ccagctaggggaagcagttg

SEQ ID NO: 817041 - DNA, 20 bp, Artificial
  CRISPR gRNA sequence
ggggaagcagttgctcactt

SEQ ID NO: 817042 - DNA, 20 bp, Artificial
  CRISPR gRNA sequence
ctcacttcagatctcctctt

SEQ ID NO: 817043 - DNA, 20 bp, Artificial
  CRISPR gRNA sequence
acttcagatctcctctttct

SEQ ID NO: 817044 - DNA, 20 bp, Artificial
  CRISPR gRNA sequence
cagatctcctctttctttct

SEQ ID NO: 817045 - DNA, 20 bp, Artificial
  CRISPR gRNA sequence
agatctcctctttctttctt

SEQ ID NO: 817046 - DNA, 20 bp, Artificial
  CRISPR gRNA sequence
ctctttctttctttcttttc

SEQ ID NO: 817047 - DNA, 20 bp, Artificial
  CRISPR gRNA sequence
tttctttctttcttttcttt

SEQ ID NO: 817048 - DNA, 20 bp, Artificial
  CRISPR gRNA sequence
tctttctttcttttcttttt

SEQ ID NO: 817049 - DNA, 20 bp, Artificial
  CRISPR gRNA sequence
ctttctttcttttctttttt

SEQ ID NO: 817050 - DNA, 20 bp, Artificial
  CRISPR gRNA sequence
tttctttcttttcttttttt

SEQ ID NO: 817051 - DNA, 20 bp, Artificial
  CRISPR gRNA sequence
tctttcttttcttttttttt

SEQ ID NO: 817052 - DNA, 20 bp, Artificial
  CRISPR gRNA sequence
ctttcttttctttttttttt

SEQ ID NO: 817053 - DNA, 20 bp, Artificial
  CRISPR gRNA sequence
tttcttttcttttttttttt

SEQ ID NO: 817054 - DNA, 20 bp, Artificial
  CRISPR gRNA sequence
tcttttcttttttttttttt

SEQ ID NO: 817055 - DNA, 20 bp, Artificial
  CRISPR gRNA sequence
cttttctttttttttttttt

SEQ ID NO: 817056 - DNA, 20 bp, Artificial
  CRISPR gRNA sequence
ttttcttttttttttttttt

SEQ ID NO: 817057 - DNA, 20 bp, Artificial
  CRISPR gRNA sequence
ttcttttttttttttttttt

SEQ ID NO: 817058 - DNA, 20 bp, Artificial
  CRISPR gRNA sequence
tctttttttttttttttttt

SEQ ID NO: 817059 - DNA, 20 bp, Artificial
  CRISPR gRNA sequence
cttttttttttttttttttt

SEQ ID NO: 817060 - DNA, 20 bp, Artificial
  CRISPR gRNA sequence
tttttttttttttttttttt

SEQ ID NO: 817061 - DNA, 20 bp, Artificial
  CRISPR gRNA sequence
tttttttttttttttttttt

SEQ ID NO: 817062 - DNA, 20 bp, Artificial
  CRISPR gRNA sequence
tttttttttttttttttttt

SEQ ID NO: 817063 - DNA, 20 bp, Artificial
  CRISPR gRNA sequence
tttttttttttttttttttt

SEQ ID NO: 817064 - DNA, 20 bp, Artificial
  CRISPR gRNA sequence
tttttttttttttttttttt

SEQ ID NO: 817065 - DNA, 20 bp, Artificial
  CRISPR gRNA sequence
tttttttttttttttttttt

SEQ ID NO: 817066 - DNA, 20 bp, Artificial
  CRISPR gRNA sequence
tttttttttttttttttttt

SEQ ID NO: 817067 - DNA, 20 bp, Artificial
  CRISPR gRNA sequence
tttttttttttttttttttg

SEQ ID NO: 817068 - DNA, 20 bp, Artificial
  CRISPR gRNA sequence
ttttttttttttttttttga

SEQ ID NO: 817069 - DNA, 20 bp, Artificial
  CRISPR gRNA sequence
tttttttttttttttttgag

SEQ ID NO: 817070 - DNA, 20 bp, Artificial
  CRISPR gRNA sequence
ttttttttttttttttgaga

SEQ ID NO: 817071 - DNA, 20 bp, Artificial
  CRISPR gRNA sequence
tttttttttttttttgagat

SEQ ID NO: 817072 - DNA, 20 bp, Artificial
  CRISPR gRNA sequence
ttttttttttttttgagatg

SEQ ID NO: 817073 - DNA, 20 bp, Artificial
  CRISPR gRNA sequence
tttttttttttttgagatgg

SEQ ID NO: 817074 - DNA, 20 bp, Artificial
  CRISPR gRNA sequence
ttttttttttttgagatgga

SEQ ID NO: 817075 - DNA, 20 bp, Artificial
  CRISPR gRNA sequence
tttttttttttgagatggag

SEQ ID NO: 817076 - DNA, 20 bp, Artificial
  CRISPR gRNA sequence
ttttttttttgagatggagt

SEQ ID NO: 817077 - DNA, 20 bp, Artificial
  CRISPR gRNA sequence
tttttttttgagatggagtc

SEQ ID NO: 817078 - DNA, 20 bp, Artificial
  CRISPR gRNA sequence
ttttttttgagatggagtct

SEQ ID NO: 817079 - DNA, 20 bp, Artificial
  CRISPR gRNA sequence
tttttttgagatggagtctt

SEQ ID NO: 817080 - DNA, 20 bp, Artificial
  CRISPR gRNA sequence
ttttttgagatggagtcttg

SEQ ID NO: 817081 - DNA, 20 bp, Artificial
  CRISPR gRNA sequence
tttttgagatggagtcttgc

SEQ ID NO: 817082 - DNA, 20 bp, Artificial
  CRISPR gRNA sequence
ttttgagatggagtcttgct

SEQ ID NO: 817083 - DNA, 20 bp, Artificial
  CRISPR gRNA sequence
tttgagatggagtcttgctc

SEQ ID NO: 817084 - DNA, 20 bp, Artificial
  CRISPR gRNA sequence
ttgagatggagtcttgctct

SEQ ID NO: 817085 - DNA, 20 bp, Artificial
  CRISPR gRNA sequence
tgagatggagtcttgctctc

SEQ ID NO: 817086 - DNA, 20 bp, Artificial
  CRISPR gRNA sequence
gagatggagtcttgctctct

SEQ ID NO: 817087 - DNA, 20 bp, Artificial
  CRISPR gRNA sequence
agatggagtcttgctctctc

SEQ ID NO: 817088 - DNA, 20 bp, Artificial
  CRISPR gRNA sequence
gctctctcacccaggctgga

SEQ ID NO: 817089 - DNA, 20 bp, Artificial
  CRISPR gRNA sequence
ctctctcacccaggctggag

SEQ ID NO: 817090 - DNA, 20 bp, Artificial
  CRISPR gRNA sequence
tctcacccaggctggagtgc

SEQ ID NO: 817091 - DNA, 20 bp, Artificial
  CRISPR gRNA sequence
tcacccaggctggagtgcag

SEQ ID NO: 817092 - DNA, 20 bp, Artificial
  CRISPR gRNA sequence
acccaggctggagtgcagtg

SEQ ID NO: 817093 - DNA, 20 bp, Artificial
  CRISPR gRNA sequence
gagtgcagtggtgtgatctt

SEQ ID NO: 817094 - DNA, 20 bp, Artificial
  CRISPR gRNA sequence
ggctcactgcatcctccgcc

SEQ ID NO: 817095 - DNA, 20 bp, Artificial
  CRISPR gRNA sequence
gctcactgcatcctccgcct

SEQ ID NO: 817096 - DNA, 20 bp, Artificial
  CRISPR gRNA sequence
actgcatcctccgcctcccg

SEQ ID NO: 817097 - DNA, 20 bp, Artificial
  CRISPR gRNA sequence
catcctccgcctcccgggtt

SEQ ID NO: 817098 - DNA, 20 bp, Artificial
  CRISPR gRNA sequence
cgcctcccgggttcaagtga

SEQ ID NO: 817099 - DNA, 20 bp, Artificial
  CRISPR gRNA sequence
ccgggttcaagtgattctcc

SEQ ID NO: 817100 - DNA, 20 bp, Artificial
  CRISPR gRNA sequence
aagtgattctcctgcctcag

SEQ ID NO: 817101 - DNA, 20 bp, Artificial
  CRISPR gRNA sequence
tcctgcctcagcctcctgag

SEQ ID NO: 817102 - DNA, 20 bp, Artificial
  CRISPR gRNA sequence
ctgcctcagcctcctgagta

SEQ ID NO: 817103 - DNA, 20 bp, Artificial
  CRISPR gRNA sequence
cctcagcctcctgagtaact

SEQ ID NO: 817104 - DNA, 20 bp, Artificial
  CRISPR gRNA sequence
agcctcctgagtaactggga

SEQ ID NO: 817105 - DNA, 20 bp, Artificial
  CRISPR gRNA sequence
ctgagtaactgggacaacag

SEQ ID NO: 817106 - DNA, 20 bp, Artificial
  CRISPR gRNA sequence
agtaactgggacaacaggcg

SEQ ID NO: 817107 - DNA, 20 bp, Artificial
  CRISPR gRNA sequence
ggacaacaggcgtgcacaac

SEQ ID NO: 817108 - DNA, 20 bp, Artificial
  CRISPR gRNA sequence
cacctggctaatttttcata

SEQ ID NO: 817109 - DNA, 20 bp, Artificial
  CRISPR gRNA sequence
gctaatttttcatattttta

SEQ ID NO: 817110 - DNA, 20 bp, Artificial
  CRISPR gRNA sequence
atttttcatatttttagtag

SEQ ID NO: 817111 - DNA, 20 bp, Artificial
  CRISPR gRNA sequence
ttcatatttttagtagagat

SEQ ID NO: 817112 - DNA, 20 bp, Artificial
  CRISPR gRNA sequence
tcatatttttagtagagatg

SEQ ID NO: 817113 - DNA, 20 bp, Artificial
  CRISPR gRNA sequence
catatttttagtagagatgg

SEQ ID NO: 817114 - DNA, 20 bp, Artificial
  CRISPR gRNA sequence
atatttttagtagagatgga

SEQ ID NO: 817115 - DNA, 20 bp, Artificial
  CRISPR gRNA sequence
ttagtagagatggagtttca

SEQ ID NO: 817116 - DNA, 20 bp, Artificial
  CRISPR gRNA sequence
tagtagagatggagtttcac

SEQ ID NO: 817117 - DNA, 20 bp, Artificial
  CRISPR gRNA sequence
agtagagatggagtttcacc

SEQ ID NO: 817118 - DNA, 20 bp, Artificial
  CRISPR gRNA sequence
gtagagatggagtttcacca

SEQ ID NO: 817119 - DNA, 20 bp, Artificial
  CRISPR gRNA sequence
caccatcttggccaagctgg

SEQ ID NO: 817120 - DNA, 20 bp, Artificial
  CRISPR gRNA sequence
accatcttggccaagctggt

SEQ ID NO: 817121 - DNA, 20 bp, Artificial
  CRISPR gRNA sequence
ggccaagctggtctcgaact

SEQ ID NO: 817122 - DNA, 20 bp, Artificial
  CRISPR gRNA sequence
gccaagctggtctcgaactc

SEQ ID NO: 817123 - DNA, 20 bp, Artificial
  CRISPR gRNA sequence
gtctcgaactctgacctcgt

SEQ ID NO: 817124 - DNA, 20 bp, Artificial
  CRISPR gRNA sequence
gaactctgacctcgtgatcc

SEQ ID NO: 817125 - DNA, 20 bp, Artificial
  CRISPR gRNA sequence
tgacctcgtgatccacccgc

SEQ ID NO: 817126 - DNA, 20 bp, Artificial
  CRISPR gRNA sequence
acctcgtgatccacccgcct

SEQ ID NO: 817127 - DNA, 20 bp, Artificial
  CRISPR gRNA sequence
gtgatccacccgcctcggcc

SEQ ID NO: 817128 - DNA, 20 bp, Artificial
  CRISPR gRNA sequence
ggcctcccaaagtgctggga

SEQ ID NO: 817129 - DNA, 20 bp, Artificial
  CRISPR gRNA sequence
ccaaagtgctgggattacag

SEQ ID NO: 817130 - DNA, 20 bp, Artificial
  CRISPR gRNA sequence
ggattacaggcgtgagccac

SEQ ID NO: 817131 - DNA, 20 bp, Artificial
  CRISPR gRNA sequence
caggcgtgagccactgtgcc

SEQ ID NO: 817132 - DNA, 20 bp, Artificial
  CRISPR gRNA sequence
tgcctggcttgtgtctcctc

SEQ ID NO: 817133 - DNA, 20 bp, Artificial
  CRISPR gRNA sequence
gcttgtgtctcctcacctct

SEQ ID NO: 817134 - DNA, 20 bp, Artificial
  CRISPR gRNA sequence
gtgtctcctcacctctctgg

SEQ ID NO: 817135 - DNA, 20 bp, Artificial
  CRISPR gRNA sequence
tgtctcctcacctctctggg

SEQ ID NO: 817136 - DNA, 20 bp, Artificial
  CRISPR gRNA sequence
ctcacctctctgggatgacc

SEQ ID NO: 817137 - DNA, 20 bp, Artificial
  CRISPR gRNA sequence
acctctctgggatgacctgc

SEQ ID NO: 817138 - DNA, 20 bp, Artificial
  CRISPR gRNA sequence
tctgggatgacctgcctgtg

SEQ ID NO: 817139 - DNA, 20 bp, Artificial
  CRISPR gRNA sequence
tgggatgacctgcctgtggt

SEQ ID NO: 817140 - DNA, 20 bp, Artificial
  CRISPR gRNA sequence
ggatgacctgcctgtggtaa

SEQ ID NO: 817141 - DNA, 20 bp, Artificial
  CRISPR gRNA sequence
cctgtggtaaggagctatcc

SEQ ID NO: 817142 - DNA, 20 bp, Artificial
  CRISPR gRNA sequence
tggtaaggagctatccattg

SEQ ID NO: 817143 - DNA, 20 bp, Artificial
  CRISPR gRNA sequence
tccattgtgggtctcctctc

SEQ ID NO: 817144 - DNA, 20 bp, Artificial
  CRISPR gRNA sequence
tgggtctcctctctgctgag

SEQ ID NO: 817145 - DNA, 20 bp, Artificial
  CRISPR gRNA sequence
ctctctgctgagagttgaac

SEQ ID NO: 817146 - DNA, 20 bp, Artificial
  CRISPR gRNA sequence
tctgctgagagttgaacact

SEQ ID NO: 817147 - DNA, 20 bp, Artificial
  CRISPR gRNA sequence
tgctgagagttgaacactca

SEQ ID NO: 817148 - DNA, 20 bp, Artificial
  CRISPR gRNA sequence
ctgagagttgaacactcatt

SEQ ID NO: 817149 - DNA, 20 bp, Artificial
  CRISPR gRNA sequence
agagttgaacactcatttcc

SEQ ID NO: 817150 - DNA, 20 bp, Artificial
  CRISPR gRNA sequence
aacactcatttcctgcctat

SEQ ID NO: 817151 - DNA, 20 bp, Artificial
  CRISPR gRNA sequence
atttcctgcctatggaaaag

SEQ ID NO: 817152 - DNA, 20 bp, Artificial
  CRISPR gRNA sequence
cctgcctatggaaaagtgct

SEQ ID NO: 817153 - DNA, 20 bp, Artificial
  CRISPR gRNA sequence
ctgcctatggaaaagtgcta

SEQ ID NO: 817154 - DNA, 20 bp, Artificial
  CRISPR gRNA sequence
cctatggaaaagtgctaccc

SEQ ID NO: 817155 - DNA, 20 bp, Artificial
  CRISPR gRNA sequence
tggaaaagtgctacccactt

SEQ ID NO: 817156 - DNA, 20 bp, Artificial
  CRISPR gRNA sequence
cccactttgggtctcctgaa

SEQ ID NO: 817157 - DNA, 20 bp, Artificial
  CRISPR gRNA sequence
tgggtctcctgaaagctgtt

SEQ ID NO: 817158 - DNA, 20 bp, Artificial
  CRISPR gRNA sequence
gggtctcctgaaagctgttc

SEQ ID NO: 817159 - DNA, 20 bp, Artificial
  CRISPR gRNA sequence
ggtctcctgaaagctgttct

SEQ ID NO: 817160 - DNA, 20 bp, Artificial
  CRISPR gRNA sequence
ctgaaagctgttctgtcact

SEQ ID NO: 817161 - DNA, 20 bp, Artificial
  CRISPR gRNA sequence
aaagctgttctgtcactcaa

SEQ ID NO: 817162 - DNA, 20 bp, Artificial
  CRISPR gRNA sequence
ttctgtcactcaacgaagct

SEQ ID NO: 817163 - DNA, 20 bp, Artificial
  CRISPR gRNA sequence
tgtcactcaacgaagctcct

SEQ ID NO: 817164 - DNA, 20 bp, Artificial
  CRISPR gRNA sequence
tcactcaacgaagctcctct

SEQ ID NO: 817165 - DNA, 20 bp, Artificial
  CRISPR gRNA sequence
aacgaagctcctctccgcct

SEQ ID NO: 817166 - DNA, 20 bp, Artificial
  CRISPR gRNA sequence
ctctccgccttgctcaccct

SEQ ID NO: 817167 - DNA, 20 bp, Artificial
  CRISPR gRNA sequence
tccgccttgctcaccctcca

SEQ ID NO: 817168 - DNA, 20 bp, Artificial
  CRISPR gRNA sequence
cgccttgctcaccctccagt

SEQ ID NO: 817169 - DNA, 20 bp, Artificial
  CRISPR gRNA sequence
gctcaccctccagttgtcca

SEQ ID NO: 817170 - DNA, 20 bp, Artificial
  CRISPR gRNA sequence
ctcaccctccagttgtccac

SEQ ID NO: 817171 - DNA, 20 bp, Artificial
  CRISPR gRNA sequence
accctccagttgtccacata

SEQ ID NO: 817172 - DNA, 20 bp, Artificial
  CRISPR gRNA sequence
cagttgtccacatacctcat

SEQ ID NO: 817173 - DNA, 20 bp, Artificial
  CRISPR gRNA sequence
tccacatacctcattttttc

SEQ ID NO: 817174 - DNA, 20 bp, Artificial
  CRISPR gRNA sequence
attttttctggacaagggac

SEQ ID NO: 817175 - DNA, 20 bp, Artificial
  CRISPR gRNA sequence
tttctggacaagggacaaga

SEQ ID NO: 817176 - DNA, 20 bp, Artificial
  CRISPR gRNA sequence
ttctggacaagggacaagaa

SEQ ID NO: 817177 - DNA, 20 bp, Artificial
  CRISPR gRNA sequence
tctggacaagggacaagaat

SEQ ID NO: 817178 - DNA, 20 bp, Artificial
  CRISPR gRNA sequence
ctggacaagggacaagaatt

SEQ ID NO: 817179 - DNA, 20 bp, Artificial
  CRISPR gRNA sequence
tggacaagggacaagaattc

SEQ ID NO: 817180 - DNA, 20 bp, Artificial
  CRISPR gRNA sequence
gacaagggacaagaattcag

SEQ ID NO: 817181 - DNA, 20 bp, Artificial
  CRISPR gRNA sequence
aggacctgccgaatggtgga

SEQ ID NO: 817182 - DNA, 20 bp, Artificial
  CRISPR gRNA sequence
ccgaatggtggactgaaaga

SEQ ID NO: 817183 - DNA, 20 bp, Artificial
  CRISPR gRNA sequence
aaagagctgtaacagaaaca

SEQ ID NO: 817184 - DNA, 20 bp, Artificial
  CRISPR gRNA sequence
taacagaaacacttatgtag

SEQ ID NO: 817185 - DNA, 20 bp, Artificial
  CRISPR gRNA sequence
atgtagctgaatgagcattg

SEQ ID NO: 817186 - DNA, 20 bp, Artificial
  CRISPR gRNA sequence
tgtagctgaatgagcattgt

SEQ ID NO: 817187 - DNA, 20 bp, Artificial
  CRISPR gRNA sequence
aatgagcattgtgctgactt

SEQ ID NO: 817188 - DNA, 20 bp, Artificial
  CRISPR gRNA sequence
tgctgacttttctccaggag

SEQ ID NO: 817189 - DNA, 20 bp, Artificial
  CRISPR gRNA sequence
acttttctccaggagacaaa

SEQ ID NO: 817190 - DNA, 20 bp, Artificial
  CRISPR gRNA sequence
ttctccaggagacaaaaacg

SEQ ID NO: 817191 - DNA, 20 bp, Artificial
  CRISPR gRNA sequence
tctccaggagacaaaaacga

SEQ ID NO: 817192 - DNA, 20 bp, Artificial
  CRISPR gRNA sequence
ctccaggagacaaaaacgaa

SEQ ID NO: 817193 - DNA, 20 bp, Artificial
  CRISPR gRNA sequence
tccaggagacaaaaacgaac

SEQ ID NO: 817194 - DNA, 20 bp, Artificial
  CRISPR gRNA sequence
caggagacaaaaacgaacat

SEQ ID NO: 817195 - DNA, 20 bp, Artificial
  CRISPR gRNA sequence
aaacaaccatgccacctctt

SEQ ID NO: 817196 - DNA, 20 bp, Artificial
  CRISPR gRNA sequence
ttaagtctccccttttaaaa

SEQ ID NO: 817197 - DNA, 20 bp, Artificial
  CRISPR gRNA sequence
aagtctccccttttaaaatt

SEQ ID NO: 817198 - DNA, 20 bp, Artificial
  CRISPR gRNA sequence
agtctccccttttaaaattc

SEQ ID NO: 817199 - DNA, 20 bp, Artificial
  CRISPR gRNA sequence
cccttttaaaattcacttgt

SEQ ID NO: 817200 - DNA, 20 bp, Artificial
  CRISPR gRNA sequence
ttaaaattcacttgtgtttt

SEQ ID NO: 817201 - DNA, 20 bp, Artificial
  CRISPR gRNA sequence
taaaattcacttgtgttttc

SEQ ID NO: 817202 - DNA, 20 bp, Artificial
  CRISPR gRNA sequence
aaaattcacttgtgttttct

SEQ ID NO: 817203 - DNA, 20 bp, Artificial
  CRISPR gRNA sequence
aaattcacttgtgttttcta

SEQ ID NO: 817204 - DNA, 20 bp, Artificial
  CRISPR gRNA sequence
acttgtgttttctaaatatg

SEQ ID NO: 817205 - DNA, 20 bp, Artificial
  CRISPR gRNA sequence
gtgttttctaaatatgttta

SEQ ID NO: 817206 - DNA, 20 bp, Artificial
  CRISPR gRNA sequence
tgttttctaaatatgtttat

SEQ ID NO: 817207 - DNA, 20 bp, Artificial
  CRISPR gRNA sequence
tctaaatatgtttattgatg

SEQ ID NO: 817208 - DNA, 20 bp, Artificial
  CRISPR gRNA sequence
ctaaatatgtttattgatgt

SEQ ID NO: 817209 - DNA, 20 bp, Artificial
  CRISPR gRNA sequence
taaatatgtttattgatgtc

SEQ ID NO: 817210 - DNA, 20 bp, Artificial
  CRISPR gRNA sequence
aatatgtttattgatgtctg

SEQ ID NO: 817211 - DNA, 20 bp, Artificial
  CRISPR gRNA sequence
attgatgtctgttcctatgt

SEQ ID NO: 817212 - DNA, 20 bp, Artificial
  CRISPR gRNA sequence
ttgatgtctgttcctatgtg

SEQ ID NO: 817213 - DNA, 20 bp, Artificial
  CRISPR gRNA sequence
atgtctgttcctatgtggct

SEQ ID NO: 817214 - DNA, 20 bp, Artificial
  CRISPR gRNA sequence
ttcctatgtggctatccatt

SEQ ID NO: 817215 - DNA, 20 bp, Artificial
  CRISPR gRNA sequence
ctatgtggctatccattttc

SEQ ID NO: 817216 - DNA, 20 bp, Artificial
  CRISPR gRNA sequence
tgtggctatccattttcatc

SEQ ID NO: 817217 - DNA, 20 bp, Artificial
  CRISPR gRNA sequence
tccattttcatcttaatgtt

SEQ ID NO: 817218 - DNA, 20 bp, Artificial
  CRISPR gRNA sequence
tcatcttaatgttattgggc

SEQ ID NO: 817219 - DNA, 20 bp, Artificial
  CRISPR gRNA sequence
catcttaatgttattgggcg

SEQ ID NO: 817220 - DNA, 20 bp, Artificial
  CRISPR gRNA sequence
atcttaatgttattgggcgg

SEQ ID NO: 817221 - DNA, 20 bp, Artificial
  CRISPR gRNA sequence
aatgttattgggcggagtta

SEQ ID NO: 817222 - DNA, 20 bp, Artificial
  CRISPR gRNA sequence
atgttattgggcggagttag

SEQ ID NO: 817223 - DNA, 20 bp, Artificial
  CRISPR gRNA sequence
ttgggcggagttagaaacta

SEQ ID NO: 817224 - DNA, 20 bp, Artificial
  CRISPR gRNA sequence
ggcggagttagaaactagaa

SEQ ID NO: 817225 - DNA, 20 bp, Artificial
  CRISPR gRNA sequence
gaaactagaaatcaacacgt

SEQ ID NO: 817226 - DNA, 20 bp, Artificial
  CRISPR gRNA sequence
gaaatcaacacgttctctaa

SEQ ID NO: 817227 - DNA, 20 bp, Artificial
  CRISPR gRNA sequence
tctaatatctgggtctcttg

SEQ ID NO: 817228 - DNA, 20 bp, Artificial
  CRISPR gRNA sequence
taatatctgggtctcttgac

SEQ ID NO: 817229 - DNA, 20 bp, Artificial
  CRISPR gRNA sequence
atatctgggtctcttgacca

SEQ ID NO: 817230 - DNA, 20 bp, Artificial
  CRISPR gRNA sequence
ggtctcttgaccaaaccaca

SEQ ID NO: 817231 - DNA, 20 bp, Artificial
  CRISPR gRNA sequence
ttgaccaaaccacaggtagt

SEQ ID NO: 817232 - DNA, 20 bp, Artificial
  CRISPR gRNA sequence
gaccaaaccacaggtagtga

SEQ ID NO: 817233 - DNA, 20 bp, Artificial
  CRISPR gRNA sequence
accaaaccacaggtagtgaa

SEQ ID NO: 817234 - DNA, 20 bp, Artificial
  CRISPR gRNA sequence
gtgggaacttggacaaggta

SEQ ID NO: 817235 - DNA, 20 bp, Artificial
  CRISPR gRNA sequence
tgggaacttggacaaggtat

SEQ ID NO: 817236 - DNA, 20 bp, Artificial
  CRISPR gRNA sequence
ggacaaggtatgtgaaaaat

SEQ ID NO: 817237 - DNA, 20 bp, Artificial
  CRISPR gRNA sequence
gacaaggtatgtgaaaaata

SEQ ID NO: 817238 - DNA, 20 bp, Artificial
  CRISPR gRNA sequence
tgcaagtggtaaacattctt

SEQ ID NO: 817239 - DNA, 20 bp, Artificial
  CRISPR gRNA sequence
gcaagtggtaaacattcttc

SEQ ID NO: 817240 - DNA, 20 bp, Artificial
  CRISPR gRNA sequence
caagtggtaaacattcttca

SEQ ID NO: 817241 - DNA, 20 bp, Artificial
  CRISPR gRNA sequence
ttcacattcatcgtcattat

SEQ ID NO: 817242 - DNA, 20 bp, Artificial
  CRISPR gRNA sequence
cacattcatcgtcattatca

SEQ ID NO: 817243 - DNA, 20 bp, Artificial
  CRISPR gRNA sequence
acattcatcgtcattatcac

SEQ ID NO: 817244 - DNA, 20 bp, Artificial
  CRISPR gRNA sequence
atcgtcattatcacttatga

SEQ ID NO: 817245 - DNA, 20 bp, Artificial
  CRISPR gRNA sequence
tcacttatgagggtggtaat

SEQ ID NO: 817246 - DNA, 20 bp, Artificial
  CRISPR gRNA sequence
atgagggtggtaatctttgg

SEQ ID NO: 817247 - DNA, 20 bp, Artificial
  CRISPR gRNA sequence
tgagggtggtaatctttggt

SEQ ID NO: 817248 - DNA, 20 bp, Artificial
  CRISPR gRNA sequence
tggtctaaaaatcccatgaa

SEQ ID NO: 817249 - DNA, 20 bp, Artificial
  CRISPR gRNA sequence
ggtctaaaaatcccatgaat

SEQ ID NO: 817250 - DNA, 20 bp, Artificial
  CRISPR gRNA sequence
gtctaaaaatcccatgaatt

SEQ ID NO: 817251 - DNA, 20 bp, Artificial
  CRISPR gRNA sequence
aaaatcccatgaattcctat

SEQ ID NO: 817252 - DNA, 20 bp, Artificial
  CRISPR gRNA sequence
ctatatgaccactcctctca

SEQ ID NO: 817253 - DNA, 20 bp, Artificial
  CRISPR gRNA sequence
tatgaccactcctctcacta

SEQ ID NO: 817254 - DNA, 20 bp, Artificial
  CRISPR gRNA sequence
ctctcactaacttcactaag

SEQ ID NO: 817255 - DNA, 20 bp, Artificial
  CRISPR gRNA sequence
tcactaacttcactaagatc

SEQ ID NO: 817256 - DNA, 20 bp, Artificial
  CRISPR gRNA sequence
actaacttcactaagatctt

SEQ ID NO: 817257 - DNA, 20 bp, Artificial
  CRISPR gRNA sequence
acttcactaagatcttgcct

SEQ ID NO: 817258 - DNA, 20 bp, Artificial
  CRISPR gRNA sequence
cactaagatcttgcctggta

SEQ ID NO: 817259 - DNA, 20 bp, Artificial
  CRISPR gRNA sequence
actaagatcttgcctggtaa

SEQ ID NO: 817260 - DNA, 20 bp, Artificial
  CRISPR gRNA sequence
agatcttgcctggtaaaagt

SEQ ID NO: 817261 - DNA, 20 bp, Artificial
  CRISPR gRNA sequence
gcctggtaaaagtctaccca

SEQ ID NO: 817262 - DNA, 20 bp, Artificial
  CRISPR gRNA sequence
cctggtaaaagtctacccat

SEQ ID NO: 817263 - DNA, 20 bp, Artificial
  CRISPR gRNA sequence
gtaaaagtctacccattttt

SEQ ID NO: 817264 - DNA, 20 bp, Artificial
  CRISPR gRNA sequence
cccattttttaagactcact

SEQ ID NO: 817265 - DNA, 20 bp, Artificial
  CRISPR gRNA sequence
tttaagactcactcagggct

SEQ ID NO: 817266 - DNA, 20 bp, Artificial
  CRISPR gRNA sequence
ttaagactcactcagggcta

SEQ ID NO: 817267 - DNA, 20 bp, Artificial
  CRISPR gRNA sequence
taagactcactcagggctac

SEQ ID NO: 817268 - DNA, 20 bp, Artificial
  CRISPR gRNA sequence
aagactcactcagggctacc

SEQ ID NO: 817269 - DNA, 20 bp, Artificial
  CRISPR gRNA sequence
agactcactcagggctacct

SEQ ID NO: 817270 - DNA, 20 bp, Artificial
  CRISPR gRNA sequence
actcagggctacctccttca

SEQ ID NO: 817271 - DNA, 20 bp, Artificial
  CRISPR gRNA sequence
agggctacctccttcataaa

SEQ ID NO: 817272 - DNA, 20 bp, Artificial
  CRISPR gRNA sequence
cctccttcataaatcctccc

SEQ ID NO: 817273 - DNA, 20 bp, Artificial
  CRISPR gRNA sequence
cttcataaatcctcccctga

SEQ ID NO: 817274 - DNA, 20 bp, Artificial
  CRISPR gRNA sequence
cataaatcctcccctgagct

SEQ ID NO: 817275 - DNA, 20 bp, Artificial
  CRISPR gRNA sequence
ataaatcctcccctgagctt

SEQ ID NO: 817276 - DNA, 20 bp, Artificial
  CRISPR gRNA sequence
ccctgagcttcccaagcaaa

SEQ ID NO: 817277 - DNA, 20 bp, Artificial
  CRISPR gRNA sequence
agcttcccaagcaaatgtct

SEQ ID NO: 817278 - DNA, 20 bp, Artificial
  CRISPR gRNA sequence
cccaagcaaatgtctgcaga

SEQ ID NO: 817279 - DNA, 20 bp, Artificial
  CRISPR gRNA sequence
ccaagcaaatgtctgcagaa

SEQ ID NO: 817280 - DNA, 20 bp, Artificial
  CRISPR gRNA sequence
cagaacgattgcgcctctca

SEQ ID NO: 817281 - DNA, 20 bp, Artificial
  CRISPR gRNA sequence
cgcctctcaggatatttctt

SEQ ID NO: 817282 - DNA, 20 bp, Artificial
  CRISPR gRNA sequence
tcaggatatttcttgtctac

SEQ ID NO: 817283 - DNA, 20 bp, Artificial
  CRISPR gRNA sequence
aggatatttcttgtctacct

SEQ ID NO: 817284 - DNA, 20 bp, Artificial
  CRISPR gRNA sequence
cttgtctaccttgtatttat

SEQ ID NO: 817285 - DNA, 20 bp, Artificial
  CRISPR gRNA sequence
ttgtctaccttgtatttatc

SEQ ID NO: 817286 - DNA, 20 bp, Artificial
  CRISPR gRNA sequence
gtctaccttgtatttatcag

SEQ ID NO: 817287 - DNA, 20 bp, Artificial
  CRISPR gRNA sequence
tctaccttgtatttatcagt

SEQ ID NO: 817288 - DNA, 20 bp, Artificial
  CRISPR gRNA sequence
ccttgtatttatcagttcat

SEQ ID NO: 817289 - DNA, 20 bp, Artificial
  CRISPR gRNA sequence
gtatttatcagttcatactc

SEQ ID NO: 817290 - DNA, 20 bp, Artificial
  CRISPR gRNA sequence
tatttatcagttcatactca

SEQ ID NO: 817291 - DNA, 20 bp, Artificial
  CRISPR gRNA sequence
atcagttcatactcaatttt

SEQ ID NO: 817292 - DNA, 20 bp, Artificial
  CRISPR gRNA sequence
tcagttcatactcaattttg

SEQ ID NO: 817293 - DNA, 20 bp, Artificial
  CRISPR gRNA sequence
atactcaattttgatcttat

SEQ ID NO: 817294 - DNA, 20 bp, Artificial
  CRISPR gRNA sequence
aattttgatcttattttgtc

SEQ ID NO: 817295 - DNA, 20 bp, Artificial
  CRISPR gRNA sequence
tgatcttattttgtcttttt

SEQ ID NO: 817296 - DNA, 20 bp, Artificial
  CRISPR gRNA sequence
gatcttattttgtctttttt

SEQ ID NO: 817297 - DNA, 20 bp, Artificial
  CRISPR gRNA sequence
atcttattttgtcttttttt

SEQ ID NO: 817298 - DNA, 20 bp, Artificial
  CRISPR gRNA sequence
attttgtctttttttttttt

SEQ ID NO: 817299 - DNA, 20 bp, Artificial
  CRISPR gRNA sequence
ttttgtcttttttttttttt

SEQ ID NO: 817300 - DNA, 20 bp, Artificial
  CRISPR gRNA sequence
tgtctttttttttttttttt

SEQ ID NO: 817301 - DNA, 20 bp, Artificial
  CRISPR gRNA sequence
gtcttttttttttttttttt

SEQ ID NO: 817302 - DNA, 20 bp, Artificial
  CRISPR gRNA sequence
tctttttttttttttttttt

SEQ ID NO: 817303 - DNA, 20 bp, Artificial
  CRISPR gRNA sequence
tttttttttttttttttttt

SEQ ID NO: 817304 - DNA, 20 bp, Artificial
  CRISPR gRNA sequence
tttttttttttttttttttc

SEQ ID NO: 817305 - DNA, 20 bp, Artificial
  CRISPR gRNA sequence
ttttttttttttttttttct

SEQ ID NO: 817306 - DNA, 20 bp, Artificial
  CRISPR gRNA sequence
tttttttttttttttttctt

SEQ ID NO: 817307 - DNA, 20 bp, Artificial
  CRISPR gRNA sequence
ttttttttttttttttcttt

SEQ ID NO: 817308 - DNA, 20 bp, Artificial
  CRISPR gRNA sequence
tttttttttttttttcttta

SEQ ID NO: 817309 - DNA, 20 bp, Artificial
  CRISPR gRNA sequence
ttttttttttttttctttag

SEQ ID NO: 817310 - DNA, 20 bp, Artificial
  CRISPR gRNA sequence
tttttttttttttctttaga

SEQ ID NO: 817311 - DNA, 20 bp, Artificial
  CRISPR gRNA sequence
ttttttttttttctttagag

SEQ ID NO: 817312 - DNA, 20 bp, Artificial
  CRISPR gRNA sequence
tttttttttttctttagaga

SEQ ID NO: 817313 - DNA, 20 bp, Artificial
  CRISPR gRNA sequence
ttttttttttctttagagac

SEQ ID NO: 817314 - DNA, 20 bp, Artificial
  CRISPR gRNA sequence
tttttttttctttagagact

SEQ ID NO: 817315 - DNA, 20 bp, Artificial
  CRISPR gRNA sequence
ttttttttctttagagacta

SEQ ID NO: 817316 - DNA, 20 bp, Artificial
  CRISPR gRNA sequence
tttttttctttagagactag

SEQ ID NO: 817317 - DNA, 20 bp, Artificial
  CRISPR gRNA sequence
ttttttctttagagactagg

SEQ ID NO: 817318 - DNA, 20 bp, Artificial
  CRISPR gRNA sequence
tttttctttagagactaggt

SEQ ID NO: 817319 - DNA, 20 bp, Artificial
  CRISPR gRNA sequence
ttttctttagagactaggtc

SEQ ID NO: 817320 - DNA, 20 bp, Artificial
  CRISPR gRNA sequence
tttctttagagactaggtct

SEQ ID NO: 817321 - DNA, 20 bp, Artificial
  CRISPR gRNA sequence
ttctttagagactaggtctc

SEQ ID NO: 817322 - DNA, 20 bp, Artificial
  CRISPR gRNA sequence
tctttagagactaggtctca

SEQ ID NO: 817323 - DNA, 20 bp, Artificial
  CRISPR gRNA sequence
ctttagagactaggtctcac

SEQ ID NO: 817324 - DNA, 20 bp, Artificial
  CRISPR gRNA sequence
tttagagactaggtctcact

SEQ ID NO: 817325 - DNA, 20 bp, Artificial
  CRISPR gRNA sequence
tagagactaggtctcactca

SEQ ID NO: 817326 - DNA, 20 bp, Artificial
  CRISPR gRNA sequence
agagactaggtctcactcat

SEQ ID NO: 817327 - DNA, 20 bp, Artificial
  CRISPR gRNA sequence
gagactaggtctcactcatt

SEQ ID NO: 817328 - DNA, 20 bp, Artificial
  CRISPR gRNA sequence
ggtctcactcattgcctagc

SEQ ID NO: 817329 - DNA, 20 bp, Artificial
  CRISPR gRNA sequence
actcattgcctagcctggag

SEQ ID NO: 817330 - DNA, 20 bp, Artificial
  CRISPR gRNA sequence
attgcctagcctggagtgta

SEQ ID NO: 817331 - DNA, 20 bp, Artificial
  CRISPR gRNA sequence
cctagcctggagtgtagtgg

SEQ ID NO: 817332 - DNA, 20 bp, Artificial
  CRISPR gRNA sequence
gcctggagtgtagtggctat

SEQ ID NO: 817333 - DNA, 20 bp, Artificial
  CRISPR gRNA sequence
gagtgtagtggctattcaca

SEQ ID NO: 817334 - DNA, 20 bp, Artificial
  CRISPR gRNA sequence
ttcacaggtgtgatcataga

SEQ ID NO: 817335 - DNA, 20 bp, Artificial
  CRISPR gRNA sequence
acaggtgtgatcatagagca

SEQ ID NO: 817336 - DNA, 20 bp, Artificial
  CRISPR gRNA sequence
cagcctcgaattcctggcct

SEQ ID NO: 817337 - DNA, 20 bp, Artificial
  CRISPR gRNA sequence
gaattcctggcctcaagcaa

SEQ ID NO: 817338 - DNA, 20 bp, Artificial
  CRISPR gRNA sequence
ctggcctcaagcaaactctg

SEQ ID NO: 817339 - DNA, 20 bp, Artificial
  CRISPR gRNA sequence
gcctcaagcaaactctggct

SEQ ID NO: 817340 - DNA, 20 bp, Artificial
  CRISPR gRNA sequence
aagcaaactctggcttcaag

SEQ ID NO: 817341 - DNA, 20 bp, Artificial
  CRISPR gRNA sequence
tggcttcaagtgatcctcct

SEQ ID NO: 817342 - DNA, 20 bp, Artificial
  CRISPR gRNA sequence
gcttcaagtgatcctcctgc

SEQ ID NO: 817343 - DNA, 20 bp, Artificial
  CRISPR gRNA sequence
caagtgatcctcctgcccca

SEQ ID NO: 817344 - DNA, 20 bp, Artificial
  CRISPR gRNA sequence
aagtgatcctcctgccccag

SEQ ID NO: 817345 - DNA, 20 bp, Artificial
  CRISPR gRNA sequence
ctgccccagcctcccaagta

SEQ ID NO: 817346 - DNA, 20 bp, Artificial
  CRISPR gRNA sequence
ccccagcctcccaagtagct

SEQ ID NO: 817347 - DNA, 20 bp, Artificial
  CRISPR gRNA sequence
ccaagtagctgggactatag

SEQ ID NO: 817348 - DNA, 20 bp, Artificial
  CRISPR gRNA sequence
ggactatagttgtgggctac

SEQ ID NO: 817349 - DNA, 20 bp, Artificial
  CRISPR gRNA sequence
tagttgtgggctaccttgcc

SEQ ID NO: 817350 - DNA, 20 bp, Artificial
  CRISPR gRNA sequence
tgggctaccttgcccagctt

SEQ ID NO: 817351 - DNA, 20 bp, Artificial
  CRISPR gRNA sequence
ccttgcccagcttattctgc

SEQ ID NO: 817352 - DNA, 20 bp, Artificial
  CRISPR gRNA sequence
gcccagcttattctgcttat

SEQ ID NO: 817353 - DNA, 20 bp, Artificial
  CRISPR gRNA sequence
cccagcttattctgcttatt

SEQ ID NO: 817354 - DNA, 20 bp, Artificial
  CRISPR gRNA sequence
attctgcttatttctacata

SEQ ID NO: 817355 - DNA, 20 bp, Artificial
  CRISPR gRNA sequence
ttctgcttatttctacataa

SEQ ID NO: 817356 - DNA, 20 bp, Artificial
  CRISPR gRNA sequence
tgcttatttctacataagaa

SEQ ID NO: 817357 - DNA, 20 bp, Artificial
  CRISPR gRNA sequence
cttatttctacataagaagt

SEQ ID NO: 817358 - DNA, 20 bp, Artificial
  CRISPR gRNA sequence
atttctacataagaagtatc

SEQ ID NO: 817359 - DNA, 20 bp, Artificial
  CRISPR gRNA sequence
tttctacataagaagtatca

SEQ ID NO: 817360 - DNA, 20 bp, Artificial
  CRISPR gRNA sequence
ctacataagaagtatcaatt

SEQ ID NO: 817361 - DNA, 20 bp, Artificial
  CRISPR gRNA sequence
tacataagaagtatcaattt

SEQ ID NO: 817362 - DNA, 20 bp, Artificial
  CRISPR gRNA sequence
cataagaagtatcaatttac

SEQ ID NO: 817363 - DNA, 20 bp, Artificial
  CRISPR gRNA sequence
actcaattgcattaggaagt

SEQ ID NO: 817364 - DNA, 20 bp, Artificial
  CRISPR gRNA sequence
ctcaattgcattaggaagtt

SEQ ID NO: 817365 - DNA, 20 bp, Artificial
  CRISPR gRNA sequence
aattgcattaggaagttgta

SEQ ID NO: 817366 - DNA, 20 bp, Artificial
  CRISPR gRNA sequence
cattaggaagttgtatcttt

SEQ ID NO: 817367 - DNA, 20 bp, Artificial
  CRISPR gRNA sequence
ggaagttgtatctttccaga

SEQ ID NO: 817368 - DNA, 20 bp, Artificial
  CRISPR gRNA sequence
tatctttccagagaaatcaa

SEQ ID NO: 817369 - DNA, 20 bp, Artificial
  CRISPR gRNA sequence
tccagagaaatcaaggaaac

SEQ ID NO: 817370 - DNA, 20 bp, Artificial
  CRISPR gRNA sequence
ccagagaaatcaaggaaaca

SEQ ID NO: 817371 - DNA, 20 bp, Artificial
  CRISPR gRNA sequence
cagagaaatcaaggaaacat

SEQ ID NO: 817372 - DNA, 20 bp, Artificial
  CRISPR gRNA sequence
taaattctgaggataagttc

SEQ ID NO: 817373 - DNA, 20 bp, Artificial
  CRISPR gRNA sequence
tgaggataagttcgtaaaca

SEQ ID NO: 817374 - DNA, 20 bp, Artificial
  CRISPR gRNA sequence
aggataagttcgtaaacaga

SEQ ID NO: 817375 - DNA, 20 bp, Artificial
  CRISPR gRNA sequence
gtaaacagaaaatgaggaaa

SEQ ID NO: 817376 - DNA, 20 bp, Artificial
  CRISPR gRNA sequence
ttttcaagcaaaatttgcaa

SEQ ID NO: 817377 - DNA, 20 bp, Artificial
  CRISPR gRNA sequence
tttcaagcaaaatttgcaag

SEQ ID NO: 817378 - DNA, 20 bp, Artificial
  CRISPR gRNA sequence
ttcaagcaaaatttgcaaga

SEQ ID NO: 817379 - DNA, 20 bp, Artificial
  CRISPR gRNA sequence
tcaagcaaaatttgcaagag

SEQ ID NO: 817380 - DNA, 20 bp, Artificial
  CRISPR gRNA sequence
caagcaaaatttgcaagagg

SEQ ID NO: 817381 - DNA, 20 bp, Artificial
  CRISPR gRNA sequence
aagcaaaatttgcaagagga

SEQ ID NO: 817382 - DNA, 20 bp, Artificial
  CRISPR gRNA sequence
gcaagaggatcagaaatgat

SEQ ID NO: 817383 - DNA, 20 bp, Artificial
  CRISPR gRNA sequence
caagaggatcagaaatgatg

SEQ ID NO: 817384 - DNA, 20 bp, Artificial
  CRISPR gRNA sequence
tagcagtttcacttcttggt

SEQ ID NO: 817385 - DNA, 20 bp, Artificial
  CRISPR gRNA sequence
gcagtttcacttcttggttg

SEQ ID NO: 817386 - DNA, 20 bp, Artificial
  CRISPR gRNA sequence
cacttcttggttgctatagg

SEQ ID NO: 817387 - DNA, 20 bp, Artificial
  CRISPR gRNA sequence
acttcttggttgctataggc

SEQ ID NO: 817388 - DNA, 20 bp, Artificial
  CRISPR gRNA sequence
cttggttgctataggcctag

SEQ ID NO: 817389 - DNA, 20 bp, Artificial
  CRISPR gRNA sequence
ttggttgctataggcctagt

SEQ ID NO: 817390 - DNA, 20 bp, Artificial
  CRISPR gRNA sequence
ggttgctataggcctagttt

SEQ ID NO: 817391 - DNA, 20 bp, Artificial
  CRISPR gRNA sequence
gttgctataggcctagtttc

SEQ ID NO: 817392 - DNA, 20 bp, Artificial
  CRISPR gRNA sequence
ctataggcctagtttcttgc

SEQ ID NO: 817393 - DNA, 20 bp, Artificial
  CRISPR gRNA sequence
taggcctagtttcttgccat

SEQ ID NO: 817394 - DNA, 20 bp, Artificial
  CRISPR gRNA sequence
gtttcttgccatttctactg

SEQ ID NO: 817395 - DNA, 20 bp, Artificial
  CRISPR gRNA sequence
cttgccatttctactgtctg

SEQ ID NO: 817396 - DNA, 20 bp, Artificial
  CRISPR gRNA sequence
ttgccatttctactgtctgt

SEQ ID NO: 817397 - DNA, 20 bp, Artificial
  CRISPR gRNA sequence
gccatttctactgtctgtgg

SEQ ID NO: 817398 - DNA, 20 bp, Artificial
  CRISPR gRNA sequence
ccatttctactgtctgtgga

SEQ ID NO: 817399 - DNA, 20 bp, Artificial
  CRISPR gRNA sequence
ctactgtctgtggagatcta

SEQ ID NO: 817400 - DNA, 20 bp, Artificial
  CRISPR gRNA sequence
tactgtctgtggagatctat

SEQ ID NO: 817401 - DNA, 20 bp, Artificial
  CRISPR gRNA sequence
ctgtctgtggagatctattt

SEQ ID NO: 817402 - DNA, 20 bp, Artificial
  CRISPR gRNA sequence
tctgtggagatctatttcca

SEQ ID NO: 817403 - DNA, 20 bp, Artificial
  CRISPR gRNA sequence
tggagatctatttccaaact

SEQ ID NO: 817404 - DNA, 20 bp, Artificial
  CRISPR gRNA sequence
tttccaaactgatagatgaa

SEQ ID NO: 817405 - DNA, 20 bp, Artificial
  CRISPR gRNA sequence
ccaaactgatagatgaaata

SEQ ID NO: 817406 - DNA, 20 bp, Artificial
  CRISPR gRNA sequence
caaactgatagatgaaatac

SEQ ID NO: 817407 - DNA, 20 bp, Artificial
  CRISPR gRNA sequence
atagatgaaatacaaataat

SEQ ID NO: 817408 - DNA, 20 bp, Artificial
  CRISPR gRNA sequence
tggtgctgaagctttaatta

SEQ ID NO: 817409 - DNA, 20 bp, Artificial
  CRISPR gRNA sequence
aagctttaattatctctttc

SEQ ID NO: 817410 - DNA, 20 bp, Artificial
  CRISPR gRNA sequence
taattatctctttcttttat

SEQ ID NO: 817411 - DNA, 20 bp, Artificial
  CRISPR gRNA sequence
aattatctctttcttttatt

SEQ ID NO: 817412 - DNA, 20 bp, Artificial
  CRISPR gRNA sequence
attatctctttcttttattc

SEQ ID NO: 817413 - DNA, 20 bp, Artificial
  CRISPR gRNA sequence
tctctttcttttattcaaaa

SEQ ID NO: 817414 - DNA, 20 bp, Artificial
  CRISPR gRNA sequence
tttcttttattcaaaacatt

SEQ ID NO: 817415 - DNA, 20 bp, Artificial
  CRISPR gRNA sequence
tcttttattcaaaacattta

SEQ ID NO: 817416 - DNA, 20 bp, Artificial
  CRISPR gRNA sequence
cttttattcaaaacatttac

SEQ ID NO: 817417 - DNA, 20 bp, Artificial
  CRISPR gRNA sequence
ttttattcaaaacatttact

SEQ ID NO: 817418 - DNA, 20 bp, Artificial
  CRISPR gRNA sequence
ttattcaaaacatttacttg

SEQ ID NO: 817419 - DNA, 20 bp, Artificial
  CRISPR gRNA sequence
tattcaaaacatttacttgg

SEQ ID NO: 817420 - DNA, 20 bp, Artificial
  CRISPR gRNA sequence
attcaaaacatttacttggt

SEQ ID NO: 817421 - DNA, 20 bp, Artificial
  CRISPR gRNA sequence
ttcaaaacatttacttggta

SEQ ID NO: 817422 - DNA, 20 bp, Artificial
  CRISPR gRNA sequence
aaaacatttacttggtattt

SEQ ID NO: 817423 - DNA, 20 bp, Artificial
  CRISPR gRNA sequence
acttggtatttactatgtgc

SEQ ID NO: 817424 - DNA, 20 bp, Artificial
  CRISPR gRNA sequence
cttggtatttactatgtgcc

SEQ ID NO: 817425 - DNA, 20 bp, Artificial
  CRISPR gRNA sequence
ggtatttactatgtgccaag

SEQ ID NO: 817426 - DNA, 20 bp, Artificial
  CRISPR gRNA sequence
gtatttactatgtgccaagc

SEQ ID NO: 817427 - DNA, 20 bp, Artificial
  CRISPR gRNA sequence
actatgtgccaagctctagt

SEQ ID NO: 817428 - DNA, 20 bp, Artificial
  CRISPR gRNA sequence
ctatgtgccaagctctagta

SEQ ID NO: 817429 - DNA, 20 bp, Artificial
  CRISPR gRNA sequence
tgtgccaagctctagtatac

SEQ ID NO: 817430 - DNA, 20 bp, Artificial
  CRISPR gRNA sequence
tagtatacaagggtaaataa

SEQ ID NO: 817431 - DNA, 20 bp, Artificial
  CRISPR gRNA sequence
gtatacaagggtaaataaga

SEQ ID NO: 817432 - DNA, 20 bp, Artificial
  CRISPR gRNA sequence
ttatggaattctctggtctg

SEQ ID NO: 817433 - DNA, 20 bp, Artificial
  CRISPR gRNA sequence
tatggaattctctggtctgt

SEQ ID NO: 817434 - DNA, 20 bp, Artificial
  CRISPR gRNA sequence
atggaattctctggtctgtg

SEQ ID NO: 817435 - DNA, 20 bp, Artificial
  CRISPR gRNA sequence
tggaattctctggtctgtgc

SEQ ID NO: 817436 - DNA, 20 bp, Artificial
  CRISPR gRNA sequence
tctggtctgtgcaataagtg

SEQ ID NO: 817437 - DNA, 20 bp, Artificial
  CRISPR gRNA sequence
tggtctgtgcaataagtgag

SEQ ID NO: 817438 - DNA, 20 bp, Artificial
  CRISPR gRNA sequence
gtctgtgcaataagtgaggc

SEQ ID NO: 817439 - DNA, 20 bp, Artificial
  CRISPR gRNA sequence
tgcaataagtgaggcataga

SEQ ID NO: 817440 - DNA, 20 bp, Artificial
  CRISPR gRNA sequence
tatggaagtatctcaagaat

SEQ ID NO: 817441 - DNA, 20 bp, Artificial
  CRISPR gRNA sequence
tggaagtatctcaagaatcc

SEQ ID NO: 817442 - DNA, 20 bp, Artificial
  CRISPR gRNA sequence
aagaatcctagcaaatcatt

SEQ ID NO: 817443 - DNA, 20 bp, Artificial
  CRISPR gRNA sequence
gcaaatcattcctttgtgta

SEQ ID NO: 817444 - DNA, 20 bp, Artificial
  CRISPR gRNA sequence
ctttgtgtaacaataaccag

SEQ ID NO: 817445 - DNA, 20 bp, Artificial
  CRISPR gRNA sequence
tgtgtaacaataaccagcct

SEQ ID NO: 817446 - DNA, 20 bp, Artificial
  CRISPR gRNA sequence
gtgtaacaataaccagccta

SEQ ID NO: 817447 - DNA, 20 bp, Artificial
  CRISPR gRNA sequence
tgtaacaataaccagcctaa

SEQ ID NO: 817448 - DNA, 20 bp, Artificial
  CRISPR gRNA sequence
aaggatcatgtttgtaaaat

SEQ ID NO: 817449 - DNA, 20 bp, Artificial
  CRISPR gRNA sequence
gtaaaatacttcattctttg

SEQ ID NO: 817450 - DNA, 20 bp, Artificial
  CRISPR gRNA sequence
taaaatacttcattctttgt

SEQ ID NO: 817451 - DNA, 20 bp, Artificial
  CRISPR gRNA sequence
cattctttgttaaatactgc

SEQ ID NO: 817452 - DNA, 20 bp, Artificial
  CRISPR gRNA sequence
attctttgttaaatactgcc

SEQ ID NO: 817453 - DNA, 20 bp, Artificial
  CRISPR gRNA sequence
tttgttaaatactgccagtc

SEQ ID NO: 817454 - DNA, 20 bp, Artificial
  CRISPR gRNA sequence
tgttaaatactgccagtctt

SEQ ID NO: 817455 - DNA, 20 bp, Artificial
  CRISPR gRNA sequence
gttaaatactgccagtctta

SEQ ID NO: 817456 - DNA, 20 bp, Artificial
  CRISPR gRNA sequence
ttaaatactgccagtcttat

SEQ ID NO: 817457 - DNA, 20 bp, Artificial
  CRISPR gRNA sequence
aatactgccagtcttatccc

SEQ ID NO: 817458 - DNA, 20 bp, Artificial
  CRISPR gRNA sequence
ccagtcttatcccatttgcc

SEQ ID NO: 817459 - DNA, 20 bp, Artificial
  CRISPR gRNA sequence
atcccatttgcctcttccct

SEQ ID NO: 817460 - DNA, 20 bp, Artificial
  CRISPR gRNA sequence
tcccatttgcctcttccctc

SEQ ID NO: 817461 - DNA, 20 bp, Artificial
  CRISPR gRNA sequence
gcctcttccctctcccagtg

SEQ ID NO: 817462 - DNA, 20 bp, Artificial
  CRISPR gRNA sequence
cctcttccctctcccagtgt

SEQ ID NO: 817463 - DNA, 20 bp, Artificial
  CRISPR gRNA sequence
ttccctctcccagtgtctag

SEQ ID NO: 817464 - DNA, 20 bp, Artificial
  CRISPR gRNA sequence
ccctctcccagtgtctagta

SEQ ID NO: 817465 - DNA, 20 bp, Artificial
  CRISPR gRNA sequence
cctctcccagtgtctagtag

SEQ ID NO: 817466 - DNA, 20 bp, Artificial
  CRISPR gRNA sequence
tcccagtgtctagtagagcc

SEQ ID NO: 817467 - DNA, 20 bp, Artificial
  CRISPR gRNA sequence
ccagtgtctagtagagcccg

SEQ ID NO: 817468 - DNA, 20 bp, Artificial
  CRISPR gRNA sequence
gtagagcccggctatccatg

SEQ ID NO: 817469 - DNA, 20 bp, Artificial
  CRISPR gRNA sequence
tccatgaagacctagataaa

SEQ ID NO: 817470 - DNA, 20 bp, Artificial
  CRISPR gRNA sequence
gataaatgcatacccaattg

SEQ ID NO: 817471 - DNA, 20 bp, Artificial
  CRISPR gRNA sequence
atctgaaatacctgaactaa

SEQ ID NO: 817472 - DNA, 20 bp, Artificial
  CRISPR gRNA sequence
aaatacctgaactaaccact

SEQ ID NO: 817473 - DNA, 20 bp, Artificial
  CRISPR gRNA sequence
aactaaccactgttttgaag

SEQ ID NO: 817474 - DNA, 20 bp, Artificial
  CRISPR gRNA sequence
accactgttttgaagccaag

SEQ ID NO: 817475 - DNA, 20 bp, Artificial
  CRISPR gRNA sequence
ttttgaagccaagtgtctaa

SEQ ID NO: 817476 - DNA, 20 bp, Artificial
  CRISPR gRNA sequence
tgaagccaagtgtctaagac

SEQ ID NO: 817477 - DNA, 20 bp, Artificial
  CRISPR gRNA sequence
gaagccaagtgtctaagaca

SEQ ID NO: 817478 - DNA, 20 bp, Artificial
  CRISPR gRNA sequence
aagccaagtgtctaagacac

SEQ ID NO: 817479 - DNA, 20 bp, Artificial
  CRISPR gRNA sequence
agacactaattgtaattagc

SEQ ID NO: 817480 - DNA, 20 bp, Artificial
  CRISPR gRNA sequence
attgtaattagcaatgtctg

SEQ ID NO: 817481 - DNA, 20 bp, Artificial
  CRISPR gRNA sequence
taattagcaatgtctgaaca

SEQ ID NO: 817482 - DNA, 20 bp, Artificial
  CRISPR gRNA sequence
gcaatgtctgaacataatct

SEQ ID NO: 817483 - DNA, 20 bp, Artificial
  CRISPR gRNA sequence
aacataatctgaatttgaat

SEQ ID NO: 817484 - DNA, 20 bp, Artificial
  CRISPR gRNA sequence
aatttgaatgcctttgggca

SEQ ID NO: 817485 - DNA, 20 bp, Artificial
  CRISPR gRNA sequence
gaatgcctttgggcaagtta

SEQ ID NO: 817486 - DNA, 20 bp, Artificial
  CRISPR gRNA sequence
aatgcctttgggcaagttat

SEQ ID NO: 817487 - DNA, 20 bp, Artificial
  CRISPR gRNA sequence
tgggcaagttatgcagagtt

SEQ ID NO: 817488 - DNA, 20 bp, Artificial
  CRISPR gRNA sequence
gggcaagttatgcagagttt

SEQ ID NO: 817489 - DNA, 20 bp, Artificial
  CRISPR gRNA sequence
ggcaagttatgcagagtttg

SEQ ID NO: 817490 - DNA, 20 bp, Artificial
  CRISPR gRNA sequence
tgcagagtttgccccaggtc

SEQ ID NO: 817491 - DNA, 20 bp, Artificial
  CRISPR gRNA sequence
gccccaggtcctaccatttt

SEQ ID NO: 817492 - DNA, 20 bp, Artificial
  CRISPR gRNA sequence
ccccaggtcctaccattttc

SEQ ID NO: 817493 - DNA, 20 bp, Artificial
  CRISPR gRNA sequence
ccattttccattgtattaga

SEQ ID NO: 817494 - DNA, 20 bp, Artificial
  CRISPR gRNA sequence
tccattgtattagacctagc

SEQ ID NO: 817495 - DNA, 20 bp, Artificial
  CRISPR gRNA sequence
ccattgtattagacctagct

SEQ ID NO: 817496 - DNA, 20 bp, Artificial
  CRISPR gRNA sequence
cattgtattagacctagctg

SEQ ID NO: 817497 - DNA, 20 bp, Artificial
  CRISPR gRNA sequence
tattagacctagctggattc

SEQ ID NO: 817498 - DNA, 20 bp, Artificial
  CRISPR gRNA sequence
gacctagctggattcactta

SEQ ID NO: 817499 - DNA, 20 bp, Artificial
  CRISPR gRNA sequence
gctggattcacttatttttg

SEQ ID NO: 817500 - DNA, 20 bp, Artificial
  CRISPR gRNA sequence
gattcacttatttttgttgc

SEQ ID NO: 817501 - DNA, 20 bp, Artificial
  CRISPR gRNA sequence
acttatttttgttgcctgac

SEQ ID NO: 817502 - DNA, 20 bp, Artificial
  CRISPR gRNA sequence
atttttgttgcctgacaaac

SEQ ID NO: 817503 - DNA, 20 bp, Artificial
  CRISPR gRNA sequence
tttttgttgcctgacaaacc

SEQ ID NO: 817504 - DNA, 20 bp, Artificial
  CRISPR gRNA sequence
ttgttgcctgacaaacccaa

SEQ ID NO: 817505 - DNA, 20 bp, Artificial
  CRISPR gRNA sequence
tgttgcctgacaaacccaat

SEQ ID NO: 817506 - DNA, 20 bp, Artificial
  CRISPR gRNA sequence
gttgcctgacaaacccaata

SEQ ID NO: 817507 - DNA, 20 bp, Artificial
  CRISPR gRNA sequence
ttgcctgacaaacccaatag

SEQ ID NO: 817508 - DNA, 20 bp, Artificial
  CRISPR gRNA sequence
cctgacaaacccaataggta

SEQ ID NO: 817509 - DNA, 20 bp, Artificial
  CRISPR gRNA sequence
acaaacccaataggtatttg

SEQ ID NO: 817510 - DNA, 20 bp, Artificial
  CRISPR gRNA sequence
gagttttggggggatcttac

SEQ ID NO: 817511 - DNA, 20 bp, Artificial
  CRISPR gRNA sequence
agttttggggggatcttaca

SEQ ID NO: 817512 - DNA, 20 bp, Artificial
  CRISPR gRNA sequence
tggggggatcttacagccag

SEQ ID NO: 817513 - DNA, 20 bp, Artificial
  CRISPR gRNA sequence
ggggggatcttacagccagt

SEQ ID NO: 817514 - DNA, 20 bp, Artificial
  CRISPR gRNA sequence
gggggatcttacagccagta

SEQ ID NO: 817515 - DNA, 20 bp, Artificial
  CRISPR gRNA sequence
acagccagtactctgctgtc

SEQ ID NO: 817516 - DNA, 20 bp, Artificial
  CRISPR gRNA sequence
cagccagtactctgctgtca

SEQ ID NO: 817517 - DNA, 20 bp, Artificial
  CRISPR gRNA sequence
tgctgtcataggtatatgag

SEQ ID NO: 817518 - DNA, 20 bp, Artificial
  CRISPR gRNA sequence
ctgtcataggtatatgagta

SEQ ID NO: 817519 - DNA, 20 bp, Artificial
  CRISPR gRNA sequence
tcataggtatatgagtaatt

SEQ ID NO: 817520 - DNA, 20 bp, Artificial
  CRISPR gRNA sequence
tttgatctctaaaccatctg

SEQ ID NO: 817521 - DNA, 20 bp, Artificial
  CRISPR gRNA sequence
gatctctaaaccatctgtgg

SEQ ID NO: 817522 - DNA, 20 bp, Artificial
  CRISPR gRNA sequence
atctctaaaccatctgtggc

SEQ ID NO: 817523 - DNA, 20 bp, Artificial
  CRISPR gRNA sequence
taaaccatctgtggcataga

SEQ ID NO: 817524 - DNA, 20 bp, Artificial
  CRISPR gRNA sequence
aaccatctgtggcatagata

SEQ ID NO: 817525 - DNA, 20 bp, Artificial
  CRISPR gRNA sequence
tggcatagatagactaccag

SEQ ID NO: 817526 - DNA, 20 bp, Artificial
  CRISPR gRNA sequence
ccagtagccttaagatgcta

SEQ ID NO: 817527 - DNA, 20 bp, Artificial
  CRISPR gRNA sequence
aagatgctattctactcaat

SEQ ID NO: 817528 - DNA, 20 bp, Artificial
  CRISPR gRNA sequence
agatgctattctactcaatt

SEQ ID NO: 817529 - DNA, 20 bp, Artificial
  CRISPR gRNA sequence
ttctactcaatttaatagag

SEQ ID NO: 817530 - DNA, 20 bp, Artificial
  CRISPR gRNA sequence
tactcaatttaatagagcat

SEQ ID NO: 817531 - DNA, 20 bp, Artificial
  CRISPR gRNA sequence
ctcaatttaatagagcattt

SEQ ID NO: 817532 - DNA, 20 bp, Artificial
  CRISPR gRNA sequence
aatttaatagagcatttaag

SEQ ID NO: 817533 - DNA, 20 bp, Artificial
  CRISPR gRNA sequence
aatagagcatttaagttcaa

SEQ ID NO: 817534 - DNA, 20 bp, Artificial
  CRISPR gRNA sequence
atagagcatttaagttcaaa

SEQ ID NO: 817535 - DNA, 20 bp, Artificial
  CRISPR gRNA sequence
aagttcaaattaaatctcaa

SEQ ID NO: 817536 - DNA, 20 bp, Artificial
  CRISPR gRNA sequence
agttcaaattaaatctcaat

SEQ ID NO: 817537 - DNA, 20 bp, Artificial
  CRISPR gRNA sequence
aaattaaatctcaatttttt

SEQ ID NO: 817538 - DNA, 20 bp, Artificial
  CRISPR gRNA sequence
aatctcaattttttaagcaa

SEQ ID NO: 817539 - DNA, 20 bp, Artificial
  CRISPR gRNA sequence
aattttttaagcaataaaca

SEQ ID NO: 817540 - DNA, 20 bp, Artificial
  CRISPR gRNA sequence
tttaagcaataaacagtgag

SEQ ID NO: 817541 - DNA, 20 bp, Artificial
  CRISPR gRNA sequence
ttaagcaataaacagtgagt

SEQ ID NO: 817542 - DNA, 20 bp, Artificial
  CRISPR gRNA sequence
taagcaataaacagtgagtt

SEQ ID NO: 817543 - DNA, 20 bp, Artificial
  CRISPR gRNA sequence
aagcaataaacagtgagttc

SEQ ID NO: 817544 - DNA, 20 bp, Artificial
  CRISPR gRNA sequence
agcaataaacagtgagttcc

SEQ ID NO: 817545 - DNA, 20 bp, Artificial
  CRISPR gRNA sequence
ccactttttataagccttta

SEQ ID NO: 817546 - DNA, 20 bp, Artificial
  CRISPR gRNA sequence
tttataagcctttatattag

SEQ ID NO: 817547 - DNA, 20 bp, Artificial
  CRISPR gRNA sequence
ttataagcctttatattaga

SEQ ID NO: 817548 - DNA, 20 bp, Artificial
  CRISPR gRNA sequence
tataagcctttatattagaa

SEQ ID NO: 817549 - DNA, 20 bp, Artificial
  CRISPR gRNA sequence
ataagcctttatattagaaa

SEQ ID NO: 817550 - DNA, 20 bp, Artificial
  CRISPR gRNA sequence
taagcctttatattagaaag

SEQ ID NO: 817551 - DNA, 20 bp, Artificial
  CRISPR gRNA sequence
tatattagaaagttgtgaga

SEQ ID NO: 817552 - DNA, 20 bp, Artificial
  CRISPR gRNA sequence
atattagaaagttgtgagaa

SEQ ID NO: 817553 - DNA, 20 bp, Artificial
  CRISPR gRNA sequence
tattagaaagttgtgagaat

SEQ ID NO: 817554 - DNA, 20 bp, Artificial
  CRISPR gRNA sequence
gaaagttgtgagaattcata

SEQ ID NO: 817555 - DNA, 20 bp, Artificial
  CRISPR gRNA sequence
tgagaattcatagaataatt

SEQ ID NO: 817556 - DNA, 20 bp, Artificial
  CRISPR gRNA sequence
atagaataatttatcattgg

SEQ ID NO: 817557 - DNA, 20 bp, Artificial
  CRISPR gRNA sequence
atcattggagaattcataga

SEQ ID NO: 817558 - DNA, 20 bp, Artificial
  CRISPR gRNA sequence
tcattggagaattcatagag

SEQ ID NO: 817559 - DNA, 20 bp, Artificial
  CRISPR gRNA sequence
gagaattcatagagggtttc

SEQ ID NO: 817560 - DNA, 20 bp, Artificial
  CRISPR gRNA sequence
atagagggtttcctctaaga

SEQ ID NO: 817561 - DNA, 20 bp, Artificial
  CRISPR gRNA sequence
cctctaagaaagggcccttg

SEQ ID NO: 817562 - DNA, 20 bp, Artificial
  CRISPR gRNA sequence
ctctaagaaagggcccttgc

SEQ ID NO: 817563 - DNA, 20 bp, Artificial
  CRISPR gRNA sequence
taagaaagggcccttgccct

SEQ ID NO: 817564 - DNA, 20 bp, Artificial
  CRISPR gRNA sequence
agaaagggcccttgccctta

SEQ ID NO: 817565 - DNA, 20 bp, Artificial
  CRISPR gRNA sequence
gcccttaaagacattgtacc

SEQ ID NO: 817566 - DNA, 20 bp, Artificial
  CRISPR gRNA sequence
cccttaaagacattgtacca

SEQ ID NO: 817567 - DNA, 20 bp, Artificial
  CRISPR gRNA sequence
aaagacattgtaccataatt

SEQ ID NO: 817568 - DNA, 20 bp, Artificial
  CRISPR gRNA sequence
aagacattgtaccataattg

SEQ ID NO: 817569 - DNA, 20 bp, Artificial
  CRISPR gRNA sequence
taccataattggaaggttaa

SEQ ID NO: 817570 - DNA, 20 bp, Artificial
  CRISPR gRNA sequence
gaaggttaaaactctcacac

SEQ ID NO: 817571 - DNA, 20 bp, Artificial
  CRISPR gRNA sequence
aaactctcacacatgaaaaa

SEQ ID NO: 817572 - DNA, 20 bp, Artificial
  CRISPR gRNA sequence
tcacacatgaaaaatagtaa

SEQ ID NO: 817573 - DNA, 20 bp, Artificial
  CRISPR gRNA sequence
acacatgaaaaatagtaaaa

SEQ ID NO: 817574 - DNA, 20 bp, Artificial
  CRISPR gRNA sequence
atgtaaaacaagtgataaaa

SEQ ID NO: 817575 - DNA, 20 bp, Artificial
  CRISPR gRNA sequence
caaaagccctagaagttgac

SEQ ID NO: 817576 - DNA, 20 bp, Artificial
  CRISPR gRNA sequence
gaagttgactaaaggaaggg

SEQ ID NO: 817577 - DNA, 20 bp, Artificial
  CRISPR gRNA sequence
actaaaggaagggagacttc

SEQ ID NO: 817578 - DNA, 20 bp, Artificial
  CRISPR gRNA sequence
aaggaagggagacttcccag

SEQ ID NO: 817579 - DNA, 20 bp, Artificial
  CRISPR gRNA sequence
cccagaggggtaggatttga

SEQ ID NO: 817580 - DNA, 20 bp, Artificial
  CRISPR gRNA sequence
ccagaggggtaggatttgaa

SEQ ID NO: 817581 - DNA, 20 bp, Artificial
  CRISPR gRNA sequence
gaactgggcctttgaagcac

SEQ ID NO: 817582 - DNA, 20 bp, Artificial
  CRISPR gRNA sequence
aactgggcctttgaagcact

SEQ ID NO: 817583 - DNA, 20 bp, Artificial
  CRISPR gRNA sequence
ggcctttgaagcactggtag

SEQ ID NO: 817584 - DNA, 20 bp, Artificial
  CRISPR gRNA sequence
tgaagcactggtaggatttg

SEQ ID NO: 817585 - DNA, 20 bp, Artificial
  CRISPR gRNA sequence
gaagcactggtaggatttgg

SEQ ID NO: 817586 - DNA, 20 bp, Artificial
  CRISPR gRNA sequence
aagcactggtaggatttggg

SEQ ID NO: 817587 - DNA, 20 bp, Artificial
  CRISPR gRNA sequence
gtaggatttggggttgaagc

SEQ ID NO: 817588 - DNA, 20 bp, Artificial
  CRISPR gRNA sequence
ggggttgaagctattctaaa

SEQ ID NO: 817589 - DNA, 20 bp, Artificial
  CRISPR gRNA sequence
gggttgaagctattctaaag

SEQ ID NO: 817590 - DNA, 20 bp, Artificial
  CRISPR gRNA sequence
aagctattctaaagggcagt

SEQ ID NO: 817591 - DNA, 20 bp, Artificial
  CRISPR gRNA sequence
ttctaaagggcagtgcatag

SEQ ID NO: 817592 - DNA, 20 bp, Artificial
  CRISPR gRNA sequence
taaagggcagtgcatagctg

SEQ ID NO: 817593 - DNA, 20 bp, Artificial
  CRISPR gRNA sequence
aagggcagtgcatagctgac

SEQ ID NO: 817594 - DNA, 20 bp, Artificial
  CRISPR gRNA sequence
actcagaagcagtctcagag

SEQ ID NO: 817595 - DNA, 20 bp, Artificial
  CRISPR gRNA sequence
agaagcagtctcagaggtgc

SEQ ID NO: 817596 - DNA, 20 bp, Artificial
  CRISPR gRNA sequence
agaggtgcaaatgcacaggc

SEQ ID NO: 817597 - DNA, 20 bp, Artificial
  CRISPR gRNA sequence
aggggacaatgaacagagta

SEQ ID NO: 817598 - DNA, 20 bp, Artificial
  CRISPR gRNA sequence
ggctggacacttaggttgag

SEQ ID NO: 817599 - DNA, 20 bp, Artificial
  CRISPR gRNA sequence
gctggacacttaggttgaga

SEQ ID NO: 817600 - DNA, 20 bp, Artificial
  CRISPR gRNA sequence
gacacttaggttgagaatgt

SEQ ID NO: 817601 - DNA, 20 bp, Artificial
  CRISPR gRNA sequence
aggttgagaatgtcaagagc

SEQ ID NO: 817602 - DNA, 20 bp, Artificial
  CRISPR gRNA sequence
ggttgagaatgtcaagagct

SEQ ID NO: 817603 - DNA, 20 bp, Artificial
  CRISPR gRNA sequence
agaatgtcaagagcttaatg

SEQ ID NO: 817604 - DNA, 20 bp, Artificial
  CRISPR gRNA sequence
aatgccaggcagagctgcca

SEQ ID NO: 817605 - DNA, 20 bp, Artificial
  CRISPR gRNA sequence
atgccaggcagagctgccaa

SEQ ID NO: 817606 - DNA, 20 bp, Artificial
  CRISPR gRNA sequence
ccaatcgggaaatagtggca

SEQ ID NO: 817607 - DNA, 20 bp, Artificial
  CRISPR gRNA sequence
aaaaactaagtgacaatacc

SEQ ID NO: 817608 - DNA, 20 bp, Artificial
  CRISPR gRNA sequence
agtgacaataccaaaggagt

SEQ ID NO: 817609 - DNA, 20 bp, Artificial
  CRISPR gRNA sequence
aaaaagattacatctaattt

SEQ ID NO: 817610 - DNA, 20 bp, Artificial
  CRISPR gRNA sequence
catctaattttttttttgag

SEQ ID NO: 817611 - DNA, 20 bp, Artificial
  CRISPR gRNA sequence
attttttttttgagtataga

SEQ ID NO: 817612 - DNA, 20 bp, Artificial
  CRISPR gRNA sequence
tttttttgagtatagaattg

SEQ ID NO: 817613 - DNA, 20 bp, Artificial
  CRISPR gRNA sequence
ttttttgagtatagaattga

SEQ ID NO: 817614 - DNA, 20 bp, Artificial
  CRISPR gRNA sequence
tttttgagtatagaattgag

SEQ ID NO: 817615 - DNA, 20 bp, Artificial
  CRISPR gRNA sequence
ttttgagtatagaattgagg

SEQ ID NO: 817616 - DNA, 20 bp, Artificial
  CRISPR gRNA sequence
tttgagtatagaattgaggg

SEQ ID NO: 817617 - DNA, 20 bp, Artificial
  CRISPR gRNA sequence
ttgagtatagaattgagggt

SEQ ID NO: 817618 - DNA, 20 bp, Artificial
  CRISPR gRNA sequence
tgagtatagaattgagggtg

SEQ ID NO: 817619 - DNA, 20 bp, Artificial
  CRISPR gRNA sequence
gagtatagaattgagggtgg

SEQ ID NO: 817620 - DNA, 20 bp, Artificial
  CRISPR gRNA sequence
agtatagaattgagggtggg

SEQ ID NO: 817621 - DNA, 20 bp, Artificial
  CRISPR gRNA sequence
agggtgggtggaattggtag

SEQ ID NO: 817622 - DNA, 20 bp, Artificial
  CRISPR gRNA sequence
gtagacagcctctcaattag

SEQ ID NO: 817623 - DNA, 20 bp, Artificial
  CRISPR gRNA sequence
tcaattagggggtcactgta

SEQ ID NO: 817624 - DNA, 20 bp, Artificial
  CRISPR gRNA sequence
aattagggggtcactgtatt

SEQ ID NO: 817625 - DNA, 20 bp, Artificial
  CRISPR gRNA sequence
gggggtcactgtattcatct

SEQ ID NO: 817626 - DNA, 20 bp, Artificial
  CRISPR gRNA sequence
tattcatctagatgtttggt

SEQ ID NO: 817627 - DNA, 20 bp, Artificial
  CRISPR gRNA sequence
atctagatgtttggtaacaa

SEQ ID NO: 817628 - DNA, 20 bp, Artificial
  CRISPR gRNA sequence
gatgtttggtaacaaggccc

SEQ ID NO: 817629 - DNA, 20 bp, Artificial
  CRISPR gRNA sequence
ggtaacaaggccctaacttc

SEQ ID NO: 817630 - DNA, 20 bp, Artificial
  CRISPR gRNA sequence
gtaacaaggccctaacttca

SEQ ID NO: 817631 - DNA, 20 bp, Artificial
  CRISPR gRNA sequence
acttcaggtcagaaaaagga

SEQ ID NO: 817632 - DNA, 20 bp, Artificial
  CRISPR gRNA sequence
caggtcagaaaaaggaagca

SEQ ID NO: 817633 - DNA, 20 bp, Artificial
  CRISPR gRNA sequence
aggtcagaaaaaggaagcaa

SEQ ID NO: 817634 - DNA, 20 bp, Artificial
  CRISPR gRNA sequence
acaaaacaattgactgctga

SEQ ID NO: 817635 - DNA, 20 bp, Artificial
  CRISPR gRNA sequence
actgctgatcagccatgcac

SEQ ID NO: 817636 - DNA, 20 bp, Artificial
  CRISPR gRNA sequence
ctgatcagccatgcacaaga

SEQ ID NO: 817637 - DNA, 20 bp, Artificial
  CRISPR gRNA sequence
atcagccatgcacaagagac

SEQ ID NO: 817638 - DNA, 20 bp, Artificial
  CRISPR gRNA sequence
actgtggttttaagaccaga

SEQ ID NO: 817639 - DNA, 20 bp, Artificial
  CRISPR gRNA sequence
tggttttaagaccagactgg

SEQ ID NO: 817640 - DNA, 20 bp, Artificial
  CRISPR gRNA sequence
taagaccagactggcaagac

SEQ ID NO: 817641 - DNA, 20 bp, Artificial
  CRISPR gRNA sequence
aagaccagactggcaagaca

SEQ ID NO: 817642 - DNA, 20 bp, Artificial
  CRISPR gRNA sequence
agaccagactggcaagacaa

SEQ ID NO: 817643 - DNA, 20 bp, Artificial
  CRISPR gRNA sequence
gcaagacaatattggagcca

SEQ ID NO: 817644 - DNA, 20 bp, Artificial
  CRISPR gRNA sequence
gagccatgggggaggaaggg

SEQ ID NO: 817645 - DNA, 20 bp, Artificial
  CRISPR gRNA sequence
attttagagggaagacagta

SEQ ID NO: 817646 - DNA, 20 bp, Artificial
  CRISPR gRNA sequence
tagagggaagacagtaagtt

SEQ ID NO: 817647 - DNA, 20 bp, Artificial
  CRISPR gRNA sequence
agagggaagacagtaagttt

SEQ ID NO: 817648 - DNA, 20 bp, Artificial
  CRISPR gRNA sequence
gagggaagacagtaagtttg

SEQ ID NO: 817649 - DNA, 20 bp, Artificial
  CRISPR gRNA sequence
ggttttagtctgggcaaggc

SEQ ID NO: 817650 - DNA, 20 bp, Artificial
  CRISPR gRNA sequence
gttttagtctgggcaaggca

SEQ ID NO: 817651 - DNA, 20 bp, Artificial
  CRISPR gRNA sequence
tagtctgggcaaggcataag

SEQ ID NO: 817652 - DNA, 20 bp, Artificial
  CRISPR gRNA sequence
agtctgggcaaggcataagc

SEQ ID NO: 817653 - DNA, 20 bp, Artificial
  CRISPR gRNA sequence
gtctgggcaaggcataagca

SEQ ID NO: 817654 - DNA, 20 bp, Artificial
  CRISPR gRNA sequence
ggcaaggcataagcattcca

SEQ ID NO: 817655 - DNA, 20 bp, Artificial
  CRISPR gRNA sequence
caaaaaattgtaggtccaga

SEQ ID NO: 817656 - DNA, 20 bp, Artificial
  CRISPR gRNA sequence
taggtccagagtttgggaca

SEQ ID NO: 817657 - DNA, 20 bp, Artificial
  CRISPR gRNA sequence
gggacaaaatttagggctaa

SEQ ID NO: 817658 - DNA, 20 bp, Artificial
  CRISPR gRNA sequence
ggacaaaatttagggctaaa

SEQ ID NO: 817659 - DNA, 20 bp, Artificial
  CRISPR gRNA sequence
agggctaaagataaggaagt

SEQ ID NO: 817660 - DNA, 20 bp, Artificial
  CRISPR gRNA sequence
gggctaaagataaggaagtt

SEQ ID NO: 817661 - DNA, 20 bp, Artificial
  CRISPR gRNA sequence
aagataaggaagttatttct

SEQ ID NO: 817662 - DNA, 20 bp, Artificial
  CRISPR gRNA sequence
tttctaatatggaaatgtta

SEQ ID NO: 817663 - DNA, 20 bp, Artificial
  CRISPR gRNA sequence
ctaatatggaaatgttagtt

SEQ ID NO: 817664 - DNA, 20 bp, Artificial
  CRISPR gRNA sequence
taatatggaaatgttagtta

SEQ ID NO: 817665 - DNA, 20 bp, Artificial
  CRISPR gRNA sequence
atatggaaatgttagttaat

SEQ ID NO: 817666 - DNA, 20 bp, Artificial
  CRISPR gRNA sequence
gttaatattgaggaatgaat

SEQ ID NO: 817667 - DNA, 20 bp, Artificial
  CRISPR gRNA sequence
atattgaggaatgaatgaac

SEQ ID NO: 817668 - DNA, 20 bp, Artificial
  CRISPR gRNA sequence
aggaatgaatgaaccatctg

SEQ ID NO: 817669 - DNA, 20 bp, Artificial
  CRISPR gRNA sequence
atggggagaatataaaagaa

SEQ ID NO: 817670 - DNA, 20 bp, Artificial
  CRISPR gRNA sequence
taaagaaaagatctgaactc

SEQ ID NO: 817671 - DNA, 20 bp, Artificial
  CRISPR gRNA sequence
aactcaggaacgtcccaaaa

SEQ ID NO: 817672 - DNA, 20 bp, Artificial
  CRISPR gRNA sequence
aggaacgtcccaaaatttgg

SEQ ID NO: 817673 - DNA, 20 bp, Artificial
  CRISPR gRNA sequence
ggagagcaggaacagaggac

SEQ ID NO: 817674 - DNA, 20 bp, Artificial
  CRISPR gRNA sequence
gagagcaggaacagaggact

SEQ ID NO: 817675 - DNA, 20 bp, Artificial
  CRISPR gRNA sequence
gtgaaaaaggcagagacaag

SEQ ID NO: 817676 - DNA, 20 bp, Artificial
  CRISPR gRNA sequence
ccccagggcagtacttctga

SEQ ID NO: 817677 - DNA, 20 bp, Artificial
  CRISPR gRNA sequence
ctgaggcaatggaggaaaat

SEQ ID NO: 817678 - DNA, 20 bp, Artificial
  CRISPR gRNA sequence
tgaggcaatggaggaaaatc

SEQ ID NO: 817679 - DNA, 20 bp, Artificial
  CRISPR gRNA sequence
aggcaatggaggaaaatccc

SEQ ID NO: 817680 - DNA, 20 bp, Artificial
  CRISPR gRNA sequence
aaagcaggggcagttcatca

SEQ ID NO: 817681 - DNA, 20 bp, Artificial
  CRISPR gRNA sequence
atcatagggagccgtgaaga

SEQ ID NO: 817682 - DNA, 20 bp, Artificial
  CRISPR gRNA sequence
agaactggaagtcagcccac

SEQ ID NO: 817683 - DNA, 20 bp, Artificial
  CRISPR gRNA sequence
gaagtcagcccacaggtgtg

SEQ ID NO: 817684 - DNA, 20 bp, Artificial
  CRISPR gRNA sequence
gagacagctggaaggcatca

SEQ ID NO: 817685 - DNA, 20 bp, Artificial
  CRISPR gRNA sequence
gaaggcatcagaggtgactg

SEQ ID NO: 817686 - DNA, 20 bp, Artificial
  CRISPR gRNA sequence
gggctagataacctttcaga

SEQ ID NO: 817687 - DNA, 20 bp, Artificial
  CRISPR gRNA sequence
gataacctttcagatgctct

SEQ ID NO: 817688 - DNA, 20 bp, Artificial
  CRISPR gRNA sequence
tcagatgctcttgtctgtcc

SEQ ID NO: 817689 - DNA, 20 bp, Artificial
  CRISPR gRNA sequence
cagatgctcttgtctgtcct

SEQ ID NO: 817690 - DNA, 20 bp, Artificial
  CRISPR gRNA sequence
agatgctcttgtctgtcctg

SEQ ID NO: 817691 - DNA, 20 bp, Artificial
  CRISPR gRNA sequence
ttgtctgtcctggaattctg

SEQ ID NO: 817692 - DNA, 20 bp, Artificial
  CRISPR gRNA sequence
gtctgtcctggaattctgtg

SEQ ID NO: 817693 - DNA, 20 bp, Artificial
  CRISPR gRNA sequence
tctgtcctggaattctgtga

SEQ ID NO: 817694 - DNA, 20 bp, Artificial
  CRISPR gRNA sequence
tcctggaattctgtgagttg

SEQ ID NO: 817695 - DNA, 20 bp, Artificial
  CRISPR gRNA sequence
gaattctgtgagttgatttg

SEQ ID NO: 817696 - DNA, 20 bp, Artificial
  CRISPR gRNA sequence
tgtgagttgatttgaaggtt

SEQ ID NO: 817697 - DNA, 20 bp, Artificial
  CRISPR gRNA sequence
tgagttgatttgaaggttat

SEQ ID NO: 817698 - DNA, 20 bp, Artificial
  CRISPR gRNA sequence
atttgaaggttatcgagccc

SEQ ID NO: 817699 - DNA, 20 bp, Artificial
  CRISPR gRNA sequence
gaaggttatcgagcccagct

SEQ ID NO: 817700 - DNA, 20 bp, Artificial
  CRISPR gRNA sequence
aaggttatcgagcccagcta

SEQ ID NO: 817701 - DNA, 20 bp, Artificial
  CRISPR gRNA sequence
tcgagcccagctacagtgga

SEQ ID NO: 817702 - DNA, 20 bp, Artificial
  CRISPR gRNA sequence
cagtggagcagggtgtggca

SEQ ID NO: 817703 - DNA, 20 bp, Artificial
  CRISPR gRNA sequence
cagttgcccctttacagagt

SEQ ID NO: 817704 - DNA, 20 bp, Artificial
  CRISPR gRNA sequence
cccctttacagagtaaccca

SEQ ID NO: 817705 - DNA, 20 bp, Artificial
  CRISPR gRNA sequence
tacagagtaacccacgtatg

SEQ ID NO: 817706 - DNA, 20 bp, Artificial
  CRISPR gRNA sequence
acagagtaacccacgtatgc

SEQ ID NO: 817707 - DNA, 20 bp, Artificial
  CRISPR gRNA sequence
cagagtaacccacgtatgca

SEQ ID NO: 817708 - DNA, 20 bp, Artificial
  CRISPR gRNA sequence
agacatatgacatatttgga

SEQ ID NO: 817709 - DNA, 20 bp, Artificial
  CRISPR gRNA sequence
ggacattagcatgtggaatt

SEQ ID NO: 817710 - DNA, 20 bp, Artificial
  CRISPR gRNA sequence
gacattagcatgtggaatta

SEQ ID NO: 817711 - DNA, 20 bp, Artificial
  CRISPR gRNA sequence
gcatgtggaattaaaatgac

SEQ ID NO: 817712 - DNA, 20 bp, Artificial
  CRISPR gRNA sequence
aaatgacacacaacaatcta

SEQ ID NO: 817713 - DNA, 20 bp, Artificial
  CRISPR gRNA sequence
ctggttgctgtccaatgtat

SEQ ID NO: 817714 - DNA, 20 bp, Artificial
  CRISPR gRNA sequence
gttgctgtccaatgtattgt

SEQ ID NO: 817715 - DNA, 20 bp, Artificial
  CRISPR gRNA sequence
ctgtccaatgtattgtaaag

SEQ ID NO: 817716 - DNA, 20 bp, Artificial
  CRISPR gRNA sequence
tccaatgtattgtaaagcaa

SEQ ID NO: 817717 - DNA, 20 bp, Artificial
  CRISPR gRNA sequence
taaagcaaataaactctgaa

SEQ ID NO: 817718 - DNA, 20 bp, Artificial
  CRISPR gRNA sequence
tgaagcatgacccataatac

SEQ ID NO: 817719 - DNA, 20 bp, Artificial
  CRISPR gRNA sequence
aagcatgacccataatactg

SEQ ID NO: 817720 - DNA, 20 bp, Artificial
  CRISPR gRNA sequence
tctctaccatctcctttttc

SEQ ID NO: 817721 - DNA, 20 bp, Artificial
  CRISPR gRNA sequence
taccatctcctttttcaaat

SEQ ID NO: 817722 - DNA, 20 bp, Artificial
  CRISPR gRNA sequence
ccatctcctttttcaaatca

SEQ ID NO: 817723 - DNA, 20 bp, Artificial
  CRISPR gRNA sequence
ctttttcaaatcaacctcaa

SEQ ID NO: 817724 - DNA, 20 bp, Artificial
  CRISPR gRNA sequence
tttcaaatcaacctcaaact

SEQ ID NO: 817725 - DNA, 20 bp, Artificial
  CRISPR gRNA sequence
ttcaaatcaacctcaaactt

SEQ ID NO: 817726 - DNA, 20 bp, Artificial
  CRISPR gRNA sequence
tcaaatcaacctcaaacttc

SEQ ID NO: 817727 - DNA, 20 bp, Artificial
  CRISPR gRNA sequence
caaatcaacctcaaacttcc

SEQ ID NO: 817728 - DNA, 20 bp, Artificial
  CRISPR gRNA sequence
aaatcaacctcaaacttccc

SEQ ID NO: 817729 - DNA, 20 bp, Artificial
  CRISPR gRNA sequence
aaacttccccctgtccatta

SEQ ID NO: 817730 - DNA, 20 bp, Artificial
  CRISPR gRNA sequence
ccccctgtccattacacgaa

SEQ ID NO: 817731 - DNA, 20 bp, Artificial
  CRISPR gRNA sequence
cccctgtccattacacgaac

SEQ ID NO: 817732 - DNA, 20 bp, Artificial
  CRISPR gRNA sequence
tccattacacgaacatttca

SEQ ID NO: 817733 - DNA, 20 bp, Artificial
  CRISPR gRNA sequence
cacgaacatttcatttctgg

SEQ ID NO: 817734 - DNA, 20 bp, Artificial
  CRISPR gRNA sequence
catttctggtgattctcctg

SEQ ID NO: 817735 - DNA, 20 bp, Artificial
  CRISPR gRNA sequence
atttctggtgattctcctga

SEQ ID NO: 817736 - DNA, 20 bp, Artificial
  CRISPR gRNA sequence
ctggtgattctcctgacatt

SEQ ID NO: 817737 - DNA, 20 bp, Artificial
  CRISPR gRNA sequence
tggtgattctcctgacattt

SEQ ID NO: 817738 - DNA, 20 bp, Artificial
  CRISPR gRNA sequence
gtgattctcctgacatttca

SEQ ID NO: 817739 - DNA, 20 bp, Artificial
  CRISPR gRNA sequence
tcctgacatttcatcaaata

SEQ ID NO: 817740 - DNA, 20 bp, Artificial
  CRISPR gRNA sequence
ctgacatttcatcaaataaa

SEQ ID NO: 817741 - DNA, 20 bp, Artificial
  CRISPR gRNA sequence
acatttcatcaaataaatcc

SEQ ID NO: 817742 - DNA, 20 bp, Artificial
  CRISPR gRNA sequence
catcaaataaatccattcaa

SEQ ID NO: 817743 - DNA, 20 bp, Artificial
  CRISPR gRNA sequence
atcaaataaatccattcaac

SEQ ID NO: 817744 - DNA, 20 bp, Artificial
  CRISPR gRNA sequence
aacaattcggcaagcaccca

SEQ ID NO: 817745 - DNA, 20 bp, Artificial
  CRISPR gRNA sequence
ggcaagcacccactaagcac

SEQ ID NO: 817746 - DNA, 20 bp, Artificial
  CRISPR gRNA sequence
agcacctatgtgtattgcca

SEQ ID NO: 817747 - DNA, 20 bp, Artificial
  CRISPR gRNA sequence
tgtgtattgccaggtactgc

SEQ ID NO: 817748 - DNA, 20 bp, Artificial
  CRISPR gRNA sequence
ccaggtactgcactaggaac

SEQ ID NO: 817749 - DNA, 20 bp, Artificial
  CRISPR gRNA sequence
cactaggaacttgggactca

SEQ ID NO: 817750 - DNA, 20 bp, Artificial
  CRISPR gRNA sequence
ggaacttgggactcagagaa

SEQ ID NO: 817751 - DNA, 20 bp, Artificial
  CRISPR gRNA sequence
gggactcagagaaccttaaa

SEQ ID NO: 817752 - DNA, 20 bp, Artificial
  CRISPR gRNA sequence
ggactcagagaaccttaaag

SEQ ID NO: 817753 - DNA, 20 bp, Artificial
  CRISPR gRNA sequence
agagaaccttaaaggtgtgc

SEQ ID NO: 817754 - DNA, 20 bp, Artificial
  CRISPR gRNA sequence
aaaggtgtgcttcttgcctg

SEQ ID NO: 817755 - DNA, 20 bp, Artificial
  CRISPR gRNA sequence
aaggtgtgcttcttgcctgt

SEQ ID NO: 817756 - DNA, 20 bp, Artificial
  CRISPR gRNA sequence
cttgcctgtgaggagctcca

SEQ ID NO: 817757 - DNA, 20 bp, Artificial
  CRISPR gRNA sequence
ttgcctgtgaggagctccag

SEQ ID NO: 817758 - DNA, 20 bp, Artificial
  CRISPR gRNA sequence
gcctgtgaggagctccagtt

SEQ ID NO: 817759 - DNA, 20 bp, Artificial
  CRISPR gRNA sequence
cctgtgaggagctccagttc

SEQ ID NO: 817760 - DNA, 20 bp, Artificial
  CRISPR gRNA sequence
tgaggagctccagttcaatg

SEQ ID NO: 817761 - DNA, 20 bp, Artificial
  CRISPR gRNA sequence
cagttcaatggaaaagctca

SEQ ID NO: 817762 - DNA, 20 bp, Artificial
  CRISPR gRNA sequence
aatggaaaagctcaccaaca

SEQ ID NO: 817763 - DNA, 20 bp, Artificial
  CRISPR gRNA sequence
accaacaggagaaatctggg

SEQ ID NO: 817764 - DNA, 20 bp, Artificial
  CRISPR gRNA sequence
gggagaagacaccctgaagc

SEQ ID NO: 817765 - DNA, 20 bp, Artificial
  CRISPR gRNA sequence
aagcagcagacaacaaagag

SEQ ID NO: 817766 - DNA, 20 bp, Artificial
  CRISPR gRNA sequence
atgatggggagacctcaaat

SEQ ID NO: 817767 - DNA, 20 bp, Artificial
  CRISPR gRNA sequence
aaataatgaaggcaaataga

SEQ ID NO: 817768 - DNA, 20 bp, Artificial
  CRISPR gRNA sequence
cagtggcaagagcagcagga

SEQ ID NO: 817769 - DNA, 20 bp, Artificial
  CRISPR gRNA sequence
ttcatccactcacagaatct

SEQ ID NO: 817770 - DNA, 20 bp, Artificial
  CRISPR gRNA sequence
atccactcacagaatcttag

SEQ ID NO: 817771 - DNA, 20 bp, Artificial
  CRISPR gRNA sequence
acagaatcttaggcttggaa

SEQ ID NO: 817772 - DNA, 20 bp, Artificial
  CRISPR gRNA sequence
aggcttggaaaggagcttgg

SEQ ID NO: 817773 - DNA, 20 bp, Artificial
  CRISPR gRNA sequence
ggcttggaaaggagcttgga

SEQ ID NO: 817774 - DNA, 20 bp, Artificial
  CRISPR gRNA sequence
ggaaaggagcttggaggaca

SEQ ID NO: 817775 - DNA, 20 bp, Artificial
  CRISPR gRNA sequence
gaaaggagcttggaggacat

SEQ ID NO: 817776 - DNA, 20 bp, Artificial
  CRISPR gRNA sequence
ggaggacatccaggccaact

SEQ ID NO: 817777 - DNA, 20 bp, Artificial
  CRISPR gRNA sequence
gaggacatccaggccaactc

SEQ ID NO: 817778 - DNA, 20 bp, Artificial
  CRISPR gRNA sequence
cgtatttgaccctgatacaa

SEQ ID NO: 817779 - DNA, 20 bp, Artificial
  CRISPR gRNA sequence
gaccctgatacaactgtctc

SEQ ID NO: 817780 - DNA, 20 bp, Artificial
  CRISPR gRNA sequence
accctgatacaactgtctca

SEQ ID NO: 817781 - DNA, 20 bp, Artificial
  CRISPR gRNA sequence
atacaactgtctcattactg

SEQ ID NO: 817782 - DNA, 20 bp, Artificial
  CRISPR gRNA sequence
tctcattactgctcacactg

SEQ ID NO: 817783 - DNA, 20 bp, Artificial
  CRISPR gRNA sequence
attactgctcacactgaata

SEQ ID NO: 817784 - DNA, 20 bp, Artificial
  CRISPR gRNA sequence
ctgctcacactgaatatttt

SEQ ID NO: 817785 - DNA, 20 bp, Artificial
  CRISPR gRNA sequence
ctcacactgaatatttttac

SEQ ID NO: 817786 - DNA, 20 bp, Artificial
  CRISPR gRNA sequence
acactgaatatttttactct

SEQ ID NO: 817787 - DNA, 20 bp, Artificial
  CRISPR gRNA sequence
aatatttttactctgcattt

SEQ ID NO: 817788 - DNA, 20 bp, Artificial
  CRISPR gRNA sequence
ttactctgcattttgtcaat

SEQ ID NO: 817789 - DNA, 20 bp, Artificial
  CRISPR gRNA sequence
tactctgcattttgtcaatt

SEQ ID NO: 817790 - DNA, 20 bp, Artificial
  CRISPR gRNA sequence
actctgcattttgtcaattt

SEQ ID NO: 817791 - DNA, 20 bp, Artificial
  CRISPR gRNA sequence
ctctgcattttgtcaattta

SEQ ID NO: 817792 - DNA, 20 bp, Artificial
  CRISPR gRNA sequence
tgcattttgtcaatttaggt

SEQ ID NO: 817793 - DNA, 20 bp, Artificial
  CRISPR gRNA sequence
cattttgtcaatttaggtct

SEQ ID NO: 817794 - DNA, 20 bp, Artificial
  CRISPR gRNA sequence
tgtcaatttaggtctctcat

SEQ ID NO: 817795 - DNA, 20 bp, Artificial
  CRISPR gRNA sequence
gtcaatttaggtctctcatt

SEQ ID NO: 817796 - DNA, 20 bp, Artificial
  CRISPR gRNA sequence
tcaatttaggtctctcattc

SEQ ID NO: 817797 - DNA, 20 bp, Artificial
  CRISPR gRNA sequence
aggtctctcattccctgccc

SEQ ID NO: 817798 - DNA, 20 bp, Artificial
  CRISPR gRNA sequence
ggtctctcattccctgcccc

SEQ ID NO: 817799 - DNA, 20 bp, Artificial
  CRISPR gRNA sequence
tcattccctgcccctcagag

SEQ ID NO: 817800 - DNA, 20 bp, Artificial
  CRISPR gRNA sequence
attccctgcccctcagagcc

SEQ ID NO: 817801 - DNA, 20 bp, Artificial
  CRISPR gRNA sequence
cctgcccctcagagccatag

SEQ ID NO: 817802 - DNA, 20 bp, Artificial
  CRISPR gRNA sequence
cccctcagagccatagtatt

SEQ ID NO: 817803 - DNA, 20 bp, Artificial
  CRISPR gRNA sequence
agagccatagtatttttggg

SEQ ID NO: 817804 - DNA, 20 bp, Artificial
  CRISPR gRNA sequence
ttgggttaaaagtcctgatt

SEQ ID NO: 817805 - DNA, 20 bp, Artificial
  CRISPR gRNA sequence
tgggttaaaagtcctgatta

SEQ ID NO: 817806 - DNA, 20 bp, Artificial
  CRISPR gRNA sequence
gggttaaaagtcctgattag

SEQ ID NO: 817807 - DNA, 20 bp, Artificial
  CRISPR gRNA sequence
ggttaaaagtcctgattagt

SEQ ID NO: 817808 - DNA, 20 bp, Artificial
  CRISPR gRNA sequence
aaagtcctgattagttggta

SEQ ID NO: 817809 - DNA, 20 bp, Artificial
  CRISPR gRNA sequence
attagttggtaatctcactc

SEQ ID NO: 817810 - DNA, 20 bp, Artificial
  CRISPR gRNA sequence
gttggtaatctcactcaggc

SEQ ID NO: 817811 - DNA, 20 bp, Artificial
  CRISPR gRNA sequence
gtaatctcactcaggcttag

SEQ ID NO: 817812 - DNA, 20 bp, Artificial
  CRISPR gRNA sequence
actcaggcttagcctctcca

SEQ ID NO: 817813 - DNA, 20 bp, Artificial
  CRISPR gRNA sequence
aggcttagcctctccacctc

SEQ ID NO: 817814 - DNA, 20 bp, Artificial
  CRISPR gRNA sequence
agcctctccacctccatccc

SEQ ID NO: 817815 - DNA, 20 bp, Artificial
  CRISPR gRNA sequence
gcctctccacctccatcccc

SEQ ID NO: 817816 - DNA, 20 bp, Artificial
  CRISPR gRNA sequence
tccacctccatcccctccac

SEQ ID NO: 817817 - DNA, 20 bp, Artificial
  CRISPR gRNA sequence
cacctccatcccctccacat

SEQ ID NO: 817818 - DNA, 20 bp, Artificial
  CRISPR gRNA sequence
catcccctccacatgaaccc

SEQ ID NO: 817819 - DNA, 20 bp, Artificial
  CRISPR gRNA sequence
cacatgaacccattgccttt

SEQ ID NO: 817820 - DNA, 20 bp, Artificial
  CRISPR gRNA sequence
cctttgctcttctactcagt

SEQ ID NO: 817821 - DNA, 20 bp, Artificial
  CRISPR gRNA sequence
tgctcttctactcagtgcat

SEQ ID NO: 817822 - DNA, 20 bp, Artificial
  CRISPR gRNA sequence
gctcttctactcagtgcatc

SEQ ID NO: 817823 - DNA, 20 bp, Artificial
  CRISPR gRNA sequence
ctcttctactcagtgcatcc

SEQ ID NO: 817824 - DNA, 20 bp, Artificial
  CRISPR gRNA sequence
ttctactcagtgcatccagg

SEQ ID NO: 817825 - DNA, 20 bp, Artificial
  CRISPR gRNA sequence
ctactcagtgcatccaggcg

SEQ ID NO: 817826 - DNA, 20 bp, Artificial
  CRISPR gRNA sequence
tactcagtgcatccaggcgg

SEQ ID NO: 817827 - DNA, 20 bp, Artificial
  CRISPR gRNA sequence
ctcagtgcatccaggcggtg

SEQ ID NO: 817828 - DNA, 20 bp, Artificial
  CRISPR gRNA sequence
agtgcatccaggcggtgagc

SEQ ID NO: 817829 - DNA, 20 bp, Artificial
  CRISPR gRNA sequence
tttcagttctgtttaatttt

SEQ ID NO: 817830 - DNA, 20 bp, Artificial
  CRISPR gRNA sequence
cagttctgtttaatttttct

SEQ ID NO: 817831 - DNA, 20 bp, Artificial
  CRISPR gRNA sequence
agttctgtttaatttttcta

SEQ ID NO: 817832 - DNA, 20 bp, Artificial
  CRISPR gRNA sequence
tgtttaatttttctaccttt

SEQ ID NO: 817833 - DNA, 20 bp, Artificial
  CRISPR gRNA sequence
tttaatttttctaccttttc

SEQ ID NO: 817834 - DNA, 20 bp, Artificial
  CRISPR gRNA sequence
aatttttctaccttttcgct

SEQ ID NO: 817835 - DNA, 20 bp, Artificial
  CRISPR gRNA sequence
atttttctaccttttcgctg

SEQ ID NO: 817836 - DNA, 20 bp, Artificial
  CRISPR gRNA sequence
ttctaccttttcgctgatca

SEQ ID NO: 817837 - DNA, 20 bp, Artificial
  CRISPR gRNA sequence
tctaccttttcgctgatcat

SEQ ID NO: 817838 - DNA, 20 bp, Artificial
  CRISPR gRNA sequence
ctaccttttcgctgatcatt

SEQ ID NO: 817839 - DNA, 20 bp, Artificial
  CRISPR gRNA sequence
taccttttcgctgatcattt

SEQ ID NO: 817840 - DNA, 20 bp, Artificial
  CRISPR gRNA sequence
ccttttcgctgatcatttta

SEQ ID NO: 817841 - DNA, 20 bp, Artificial
  CRISPR gRNA sequence
ttcgctgatcattttatatg

SEQ ID NO: 817842 - DNA, 20 bp, Artificial
  CRISPR gRNA sequence
tcgctgatcattttatatgg

SEQ ID NO: 817843 - DNA, 20 bp, Artificial
  CRISPR gRNA sequence
cgctgatcattttatatgga

SEQ ID NO: 817844 - DNA, 20 bp, Artificial
  CRISPR gRNA sequence
gctgatcattttatatggaa

SEQ ID NO: 817845 - DNA, 20 bp, Artificial
  CRISPR gRNA sequence
atcattttatatggaaagaa

SEQ ID NO: 817846 - DNA, 20 bp, Artificial
  CRISPR gRNA sequence
tatatggaaagaataagcct

SEQ ID NO: 817847 - DNA, 20 bp, Artificial
  CRISPR gRNA sequence
atatggaaagaataagcctt

SEQ ID NO: 817848 - DNA, 20 bp, Artificial
  CRISPR gRNA sequence
tatggaaagaataagccttt

SEQ ID NO: 817849 - DNA, 20 bp, Artificial
  CRISPR gRNA sequence
tccatagtccccaaatcatg

SEQ ID NO: 817850 - DNA, 20 bp, Artificial
  CRISPR gRNA sequence
ccatagtccccaaatcatgc

SEQ ID NO: 817851 - DNA, 20 bp, Artificial
  CRISPR gRNA sequence
catagtccccaaatcatgct

SEQ ID NO: 817852 - DNA, 20 bp, Artificial
  CRISPR gRNA sequence
ttgttcaataatgattacct

SEQ ID NO: 817853 - DNA, 20 bp, Artificial
  CRISPR gRNA sequence
tgttcaataatgattacctc

SEQ ID NO: 817854 - DNA, 20 bp, Artificial
  CRISPR gRNA sequence
gttcaataatgattacctct

SEQ ID NO: 817855 - DNA, 20 bp, Artificial
  CRISPR gRNA sequence
ttcaataatgattacctcta

SEQ ID NO: 817856 - DNA, 20 bp, Artificial
  CRISPR gRNA sequence
aataatgattacctctataa

SEQ ID NO: 817857 - DNA, 20 bp, Artificial
  CRISPR gRNA sequence
cctctataagttattaagat

SEQ ID NO: 817858 - DNA, 20 bp, Artificial
  CRISPR gRNA sequence
tataagttattaagataata

SEQ ID NO: 817859 - DNA, 20 bp, Artificial
  CRISPR gRNA sequence
taagttattaagataatagt

SEQ ID NO: 817860 - DNA, 20 bp, Artificial
  CRISPR gRNA sequence
ttaagataatagttttgggt

SEQ ID NO: 817861 - DNA, 20 bp, Artificial
  CRISPR gRNA sequence
agataatagttttgggtttt

SEQ ID NO: 817862 - DNA, 20 bp, Artificial
  CRISPR gRNA sequence
tgggttttttgtttttgttc

SEQ ID NO: 817863 - DNA, 20 bp, Artificial
  CRISPR gRNA sequence
gggttttttgtttttgttcc

SEQ ID NO: 817864 - DNA, 20 bp, Artificial
  CRISPR gRNA sequence
ggttttttgtttttgttccc

SEQ ID NO: 817865 - DNA, 20 bp, Artificial
  CRISPR gRNA sequence
tttgtttttgttccccctcc

SEQ ID NO: 817866 - DNA, 20 bp, Artificial
  CRISPR gRNA sequence
ttgtttttgttccccctcca

SEQ ID NO: 817867 - DNA, 20 bp, Artificial
  CRISPR gRNA sequence
tgtttttgttccccctccac

SEQ ID NO: 817868 - DNA, 20 bp, Artificial
  CRISPR gRNA sequence
gtttttgttccccctccacc

SEQ ID NO: 817869 - DNA, 20 bp, Artificial
  CRISPR gRNA sequence
tttttgttccccctccacca

SEQ ID NO: 817870 - DNA, 20 bp, Artificial
  CRISPR gRNA sequence
ttgttccccctccaccaaca

SEQ ID NO: 817871 - DNA, 20 bp, Artificial
  CRISPR gRNA sequence
tgttccccctccaccaacag

SEQ ID NO: 817872 - DNA, 20 bp, Artificial
  CRISPR gRNA sequence
gttccccctccaccaacagc

SEQ ID NO: 817873 - DNA, 20 bp, Artificial
  CRISPR gRNA sequence
ttccccctccaccaacagct

SEQ ID NO: 817874 - DNA, 20 bp, Artificial
  CRISPR gRNA sequence
cccctccaccaacagctgcc

SEQ ID NO: 817875 - DNA, 20 bp, Artificial
  CRISPR gRNA sequence
caccaacagctgcctcttag

SEQ ID NO: 817876 - DNA, 20 bp, Artificial
  CRISPR gRNA sequence
cctcttaggcatagcttgta

SEQ ID NO: 817877 - DNA, 20 bp, Artificial
  CRISPR gRNA sequence
ttaggcatagcttgtaaaca

SEQ ID NO: 817878 - DNA, 20 bp, Artificial
  CRISPR gRNA sequence
aggcatagcttgtaaacaaa

SEQ ID NO: 817879 - DNA, 20 bp, Artificial
  CRISPR gRNA sequence
ggcatagcttgtaaacaaag

SEQ ID NO: 817880 - DNA, 20 bp, Artificial
  CRISPR gRNA sequence
gtaaacaaaggccagcctgg

SEQ ID NO: 817881 - DNA, 20 bp, Artificial
  CRISPR gRNA sequence
taaacaaaggccagcctgga

SEQ ID NO: 817882 - DNA, 20 bp, Artificial
  CRISPR gRNA sequence
gagggatcaccgtctgctaa

SEQ ID NO: 817883 - DNA, 20 bp, Artificial
  CRISPR gRNA sequence
ctaaatggataatcacaaac

SEQ ID NO: 817884 - DNA, 20 bp, Artificial
  CRISPR gRNA sequence
aatggataatcacaaacaga

SEQ ID NO: 817885 - DNA, 20 bp, Artificial
  CRISPR gRNA sequence
ttaagttcttcaccattaag

SEQ ID NO: 817886 - DNA, 20 bp, Artificial
  CRISPR gRNA sequence
taagttcttcaccattaagc

SEQ ID NO: 817887 - DNA, 20 bp, Artificial
  CRISPR gRNA sequence
aagttcttcaccattaagcc

SEQ ID NO: 817888 - DNA, 20 bp, Artificial
  CRISPR gRNA sequence
agttcttcaccattaagcct

SEQ ID NO: 817889 - DNA, 20 bp, Artificial
  CRISPR gRNA sequence
ttcaccattaagcctccgaa

SEQ ID NO: 817890 - DNA, 20 bp, Artificial
  CRISPR gRNA sequence
caccattaagcctccgaaaa

SEQ ID NO: 817891 - DNA, 20 bp, Artificial
  CRISPR gRNA sequence
accattaagcctccgaaaac

SEQ ID NO: 817892 - DNA, 20 bp, Artificial
  CRISPR gRNA sequence
agcctccgaaaactctaagc

SEQ ID NO: 817893 - DNA, 20 bp, Artificial
  CRISPR gRNA sequence
cgaaaactctaagctgagag

SEQ ID NO: 817894 - DNA, 20 bp, Artificial
  CRISPR gRNA sequence
taagctgagagacaatctta

SEQ ID NO: 817895 - DNA, 20 bp, Artificial
  CRISPR gRNA sequence
agctgagagacaatcttaag

SEQ ID NO: 817896 - DNA, 20 bp, Artificial
  CRISPR gRNA sequence
agagacaatcttaagaatag

SEQ ID NO: 817897 - DNA, 20 bp, Artificial
  CRISPR gRNA sequence
aagaatagttatattatttt

SEQ ID NO: 817898 - DNA, 20 bp, Artificial
  CRISPR gRNA sequence
agaatagttatattatttta

SEQ ID NO: 817899 - DNA, 20 bp, Artificial
  CRISPR gRNA sequence
tattattttacagtgcacat

SEQ ID NO: 817900 - DNA, 20 bp, Artificial
  CRISPR gRNA sequence
ttttacagtgcacatatttg

SEQ ID NO: 817901 - DNA, 20 bp, Artificial
  CRISPR gRNA sequence
tacagtgcacatatttggtg

SEQ ID NO: 817902 - DNA, 20 bp, Artificial
  CRISPR gRNA sequence
acagtgcacatatttggtgc

SEQ ID NO: 817903 - DNA, 20 bp, Artificial
  CRISPR gRNA sequence
cagtgcacatatttggtgca

SEQ ID NO: 817904 - DNA, 20 bp, Artificial
  CRISPR gRNA sequence
ggtgcagaaaatatctcacc

SEQ ID NO: 817905 - DNA, 20 bp, Artificial
  CRISPR gRNA sequence
gtgcagaaaatatctcacct

SEQ ID NO: 817906 - DNA, 20 bp, Artificial
  CRISPR gRNA sequence
accttataaaactgagcaac

SEQ ID NO: 817907 - DNA, 20 bp, Artificial
  CRISPR gRNA sequence
ataaaactgagcaacaagaa

SEQ ID NO: 817908 - DNA, 20 bp, Artificial
  CRISPR gRNA sequence
taaaactgagcaacaagaac

SEQ ID NO: 817909 - DNA, 20 bp, Artificial
  CRISPR gRNA sequence
agcaacaagaacaatatgca

SEQ ID NO: 817910 - DNA, 20 bp, Artificial
  CRISPR gRNA sequence
gggcaggaggacattagctt

SEQ ID NO: 817911 - DNA, 20 bp, Artificial
  CRISPR gRNA sequence
gcttatttgtgcccctcagc

SEQ ID NO: 817912 - DNA, 20 bp, Artificial
  CRISPR gRNA sequence
atttgtgcccctcagcacaa

SEQ ID NO: 817913 - DNA, 20 bp, Artificial
  CRISPR gRNA sequence
tttgtgcccctcagcacaat

SEQ ID NO: 817914 - DNA, 20 bp, Artificial
  CRISPR gRNA sequence
gtgcccctcagcacaatttc

SEQ ID NO: 817915 - DNA, 20 bp, Artificial
  CRISPR gRNA sequence
tgcccctcagcacaatttct

SEQ ID NO: 817916 - DNA, 20 bp, Artificial
  CRISPR gRNA sequence
agcacaatttctgaggcaga

SEQ ID NO: 817917 - DNA, 20 bp, Artificial
  CRISPR gRNA sequence
ctgaggcagaatgtctcttg

SEQ ID NO: 817918 - DNA, 20 bp, Artificial
  CRISPR gRNA sequence
tgaggcagaatgtctcttgc

SEQ ID NO: 817919 - DNA, 20 bp, Artificial
  CRISPR gRNA sequence
aggcagaatgtctcttgcct

SEQ ID NO: 817920 - DNA, 20 bp, Artificial
  CRISPR gRNA sequence
ttgcctcaaatggtgtggag

SEQ ID NO: 817921 - DNA, 20 bp, Artificial
  CRISPR gRNA sequence
gcctcaaatggtgtggagag

SEQ ID NO: 817922 - DNA, 20 bp, Artificial
  CRISPR gRNA sequence
cctcaaatggtgtggagaga

SEQ ID NO: 817923 - DNA, 20 bp, Artificial
  CRISPR gRNA sequence
aaatggtgtggagagaaggt

SEQ ID NO: 817924 - DNA, 20 bp, Artificial
  CRISPR gRNA sequence
cccccaccctggcagcctca

SEQ ID NO: 817925 - DNA, 20 bp, Artificial
  CRISPR gRNA sequence
ccccaccctggcagcctcat

SEQ ID NO: 817926 - DNA, 20 bp, Artificial
  CRISPR gRNA sequence
gcagcctcatcatggtccac

SEQ ID NO: 817927 - DNA, 20 bp, Artificial
  CRISPR gRNA sequence
atcatggtccacaacataat

SEQ ID NO: 817928 - DNA, 20 bp, Artificial
  CRISPR gRNA sequence
aacccactcgttactcacat

SEQ ID NO: 817929 - DNA, 20 bp, Artificial
  CRISPR gRNA sequence
gttactcacatgaggacttg

SEQ ID NO: 817930 - DNA, 20 bp, Artificial
  CRISPR gRNA sequence
ctcacatgaggacttgccac

SEQ ID NO: 817931 - DNA, 20 bp, Artificial
  CRISPR gRNA sequence
acatgaggacttgccacagc

SEQ ID NO: 817932 - DNA, 20 bp, Artificial
  CRISPR gRNA sequence
gccacagctccacaagtaaa

SEQ ID NO: 817933 - DNA, 20 bp, Artificial
  CRISPR gRNA sequence
ccacagctccacaagtaaag

SEQ ID NO: 817934 - DNA, 20 bp, Artificial
  CRISPR gRNA sequence
cacaagtaaagatgcaaaag

SEQ ID NO: 817935 - DNA, 20 bp, Artificial
  CRISPR gRNA sequence
ctgtttgtgttagatttcct

SEQ ID NO: 817936 - DNA, 20 bp, Artificial
  CRISPR gRNA sequence
tttgtgttagatttccttat

SEQ ID NO: 817937 - DNA, 20 bp, Artificial
  CRISPR gRNA sequence
gtgttagatttccttatagt

SEQ ID NO: 817938 - DNA, 20 bp, Artificial
  CRISPR gRNA sequence
tgttagatttccttatagta

SEQ ID NO: 817939 - DNA, 20 bp, Artificial
  CRISPR gRNA sequence
gatttccttatagtagccac

SEQ ID NO: 817940 - DNA, 20 bp, Artificial
  CRISPR gRNA sequence
ccttatagtagccaccaaaa

SEQ ID NO: 817941 - DNA, 20 bp, Artificial
  CRISPR gRNA sequence
cttatagtagccaccaaaat

SEQ ID NO: 817942 - DNA, 20 bp, Artificial
  CRISPR gRNA sequence
atagtagccaccaaaatgaa

SEQ ID NO: 817943 - DNA, 20 bp, Artificial
  CRISPR gRNA sequence
tagtagccaccaaaatgaac

SEQ ID NO: 817944 - DNA, 20 bp, Artificial
  CRISPR gRNA sequence
caacccaggattctttctag

SEQ ID NO: 817945 - DNA, 20 bp, Artificial
  CRISPR gRNA sequence
tttctagctgggacatatga

SEQ ID NO: 817946 - DNA, 20 bp, Artificial
  CRISPR gRNA sequence
tctagctgggacatatgagg

SEQ ID NO: 817947 - DNA, 20 bp, Artificial
  CRISPR gRNA sequence
ctagctgggacatatgagga

SEQ ID NO: 817948 - DNA, 20 bp, Artificial
  CRISPR gRNA sequence
tagctgggacatatgaggat

SEQ ID NO: 817949 - DNA, 20 bp, Artificial
  CRISPR gRNA sequence
gctgggacatatgaggatgg

SEQ ID NO: 817950 - DNA, 20 bp, Artificial
  CRISPR gRNA sequence
ggacatatgaggatgggtaa

SEQ ID NO: 817951 - DNA, 20 bp, Artificial
  CRISPR gRNA sequence
aaaatttggcgttaagatat

SEQ ID NO: 817952 - DNA, 20 bp, Artificial
  CRISPR gRNA sequence
ggcgttaagatatattcaag

SEQ ID NO: 817953 - DNA, 20 bp, Artificial
  CRISPR gRNA sequence
gcgttaagatatattcaaga

SEQ ID NO: 817954 - DNA, 20 bp, Artificial
  CRISPR gRNA sequence
agatatattcaagagaagaa

SEQ ID NO: 817955 - DNA, 20 bp, Artificial
  CRISPR gRNA sequence
aagagaagaaaagttgttca

SEQ ID NO: 817956 - DNA, 20 bp, Artificial
  CRISPR gRNA sequence
ttcattcagcttaaggtttg

SEQ ID NO: 817957 - DNA, 20 bp, Artificial
  CRISPR gRNA sequence
attcagcttaaggtttgccg

SEQ ID NO: 817958 - DNA, 20 bp, Artificial
  CRISPR gRNA sequence
agcttaaggtttgccgtaac

SEQ ID NO: 817959 - DNA, 20 bp, Artificial
  CRISPR gRNA sequence
aaggtttgccgtaacatgag

SEQ ID NO: 817960 - DNA, 20 bp, Artificial
  CRISPR gRNA sequence
aggtttgccgtaacatgaga

SEQ ID NO: 817961 - DNA, 20 bp, Artificial
  CRISPR gRNA sequence
gccgtaacatgagagtgagt

SEQ ID NO: 817962 - DNA, 20 bp, Artificial
  CRISPR gRNA sequence
ccgtaacatgagagtgagtc

SEQ ID NO: 817963 - DNA, 20 bp, Artificial
  CRISPR gRNA sequence
gttctgaggaactgacgaaa

SEQ ID NO: 817964 - DNA, 20 bp, Artificial
  CRISPR gRNA sequence
tgaggaactgacgaaagcct

SEQ ID NO: 817965 - DNA, 20 bp, Artificial
  CRISPR gRNA sequence
aggaactgacgaaagcctgg

SEQ ID NO: 817966 - DNA, 20 bp, Artificial
  CRISPR gRNA sequence
acgaaagcctggcttatttg

SEQ ID NO: 817967 - DNA, 20 bp, Artificial
  CRISPR gRNA sequence
gcttatttggaaagttttgg

SEQ ID NO: 817968 - DNA, 20 bp, Artificial
  CRISPR gRNA sequence
atttggaaagttttggtttt

SEQ ID NO: 817969 - DNA, 20 bp, Artificial
  CRISPR gRNA sequence
tttggaaagttttggttttg

SEQ ID NO: 817970 - DNA, 20 bp, Artificial
  CRISPR gRNA sequence
ggaaagttttggttttgctt

SEQ ID NO: 817971 - DNA, 20 bp, Artificial
  CRISPR gRNA sequence
gaaagttttggttttgcttt

SEQ ID NO: 817972 - DNA, 20 bp, Artificial
  CRISPR gRNA sequence
tggttttgcttttagcagtt

SEQ ID NO: 817973 - DNA, 20 bp, Artificial
  CRISPR gRNA sequence
ggttttgcttttagcagttt

SEQ ID NO: 817974 - DNA, 20 bp, Artificial
  CRISPR gRNA sequence
gttttgcttttagcagtttg

SEQ ID NO: 817975 - DNA, 20 bp, Artificial
  CRISPR gRNA sequence
tgcttttagcagtttgtctg

SEQ ID NO: 817976 - DNA, 20 bp, Artificial
  CRISPR gRNA sequence
gcttttagcagtttgtctgt

SEQ ID NO: 817977 - DNA, 2223 bp, Homo sapiens
ggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactactatggttatcttctgcctctcacagatgaagaaactaaggcaccgagattttaagaaacttaattacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaaagaaaaaaaaaaaaaaagaaagagaaaagaaaagaaagaaagaagtgaaggtttgtcagtcaggggagctgtaaaaccattaataaagataatccaagatggttaccaagactgttgaggacgccagagatcttgagcactttctaagtacctggcaatacactaagcgcgctcaccttttcctctggcaaaacatgatcgaaagcagaatgttttgatcatgagaaaattgcatttaatttgaatacaatttatttacaacataaaggataatgtatatatcaccaccattactggtatttgctggttatgttagatgtcattttaaaaaataacaatctgatatttaaaaaaaaatcttattttgaaaatttccaaagtaatacatgccatgcatagaccatttctggaagataccacaagaaacatgtaatgatgattgcctctgaaggtctattttcctcctctgacctgtgtgtgggttttgtttttgttttactgtgggcataaattaatttttcagttaagttttggaagcttaaataactctccaaaagtcataaagccagtaactggttgagcccaaattcaaacccagcctgtctgatacttgtcctcttcttagaaaagattacagtgatgctctcacaaaatcttgccgccttccctcaaacagagagttccaggcaggatgaatctgtgctctgatccctgaggcatttaatatgttcttattattagaagctcagatgcaaagagctctcttagcttttaatgttatgaaaaaaatcaggtcttcattagattccccaatccacct

SEQ ID NO: 817978 - DNA, 59 bp, Homo sapiens
aacctgtggagctgtcttgtgaggctgctcaccaaagacccagaatggctgaacgccaa

SEQ ID NO: 817979 - DNA, 59 bp, Homo sapiens
ttggacacctcgacagaacactccgacgagtggtttctgggtcttaccgacttgcggtt

SEQ ID NO: 817980 - protein, 16 aa, Homo sapiens
LWSCLVRLLTKDPEWL

SEQ ID NO: 817981 - DNA, 54 bp, Homo sapiens
cctgtggagctgtcttgtgaggctgctcaccaaagacccagaatggctgaacgc

SEQ ID NO: 817982 - DNA, 49 bp, Homo sapiens
cctgtggagctgtcttgtgaggctccaaagacccagaatggctgaacgc

SEQ ID NO: 817983 - DNA, 27 bp, Homo sapiens
cctgtggagctgtctttggctgaacgc

SEQ ID NO: 817984 - DNA, 50 bp, Homo sapiens
cctgtggagctgtcttgtgaggctccacaagacccagaatggctgaacgc

SEQ ID NO: 817985 - DNA, 54 bp, Homo sapiens
cctgtggagctgtcttgtgaggctgctcctcaccaaagacccagaatggctgaa

SEQ ID NO: 817986 - DNA, 58 bp, Homo sapiens
cttcttaacagcgatgctgaccccctgtgcctctaccacttctatgaccagatggacc

SEQ ID NO: 817987 - DNA, 58 bp, Homo sapiens
gaagaattgtcgctacgactgggggacacggagatggtgaagatactggtctacctgg

SEQ ID NO: 817988 - protein, 23 aa, Homo sapiens
LELLNSDADPLCLYHFYDQMDLA

SEQ ID NO: 817989 - DNA, 69 bp, Homo sapiens
ctggagcttcttaacagcgatgctgaccccctgtgcctctaccacttctatgaccagatggacctggct

SEQ ID NO: 817990 - DNA, 58 bp, Homo sapiens
ctggagcttcttaacagcgatgtgcctctaccacttctatgaccagatggacctggct

SEQ ID NO: 817991 - DNA, 36 bp, Homo sapiens
ctggagcttcttaacagcgaccagatggacctggct

SEQ ID NO: 817992 - DNA, 62 bp, Homo sapiens
ctggagcttcttaacagcgatgctgacgcctctaccacttctatgaccagatggacctggct

SEQ ID NO: 817993 - DNA, 61 bp, Homo sapiens
ctggagcttcttaacagcgatgctgaccctctaccacttctatgaccagatggacctggct

SEQ ID NO: 817994 - DNA, 59 bp, Homo sapiens
ctggagcttcttaacagcgatgctgactctaccacttctatgaccagatggacctggct

SEQ ID NO: 817995 - DNA, 55 bp, Homo sapiens
ctggagcttcttaacagcgatgctctaccacttctatgaccagatggacctggct

SEQ ID NO: 817996 - DNA, 58 bp, Homo sapiens
ctggagcttcttaacagcgatgctgaccccctgtgcctatgaccagatggacctggct

SEQ ID NO: 817997 - DNA, 61 bp, Homo sapiens
ctggagcttcttaacagcgatgctgaccccctaccacttctatgaccagatggacctggct

SEQ ID NO: 817998 - DNA, 52 bp, Homo sapiens
ctggagcttcttaacagcgatgctgaccccctatgaccagatggacctggct

SEQ ID NO: 817999 - DNA, 66 bp, Homo sapiens
ctggagcttcttaacagcgatgctgaccccctgctctaccacttctatgaccagatggacctggct

SEQ ID NO: 818000 - DNA, 50 bp, Homo sapiens
ctggagcttcttaacagcgatgctgaccctatgaccagatggacctggct

SEQ ID NO: 818001 - DNA, 54 bp, Homo sapiens
ctggagcttcttaacagcgatgctgaccccctctatgaccagatggacctggct

SEQ ID NO: 818002 - DNA, 42 bp, Homo sapiens
ctggagcttctctaccacttctatgaccagatggacctggct

SEQ ID NO: 818003 - DNA, 27 bp, Homo sapiens
cacttctatgaccagatggacctggct

SEQ ID NO: 818004 - DNA, 68 bp, Artificial
  CRISPR gRNA sequence
ctggagcttcttaacagcgatgctgaccccctgtacccctctacccccctctaccacttctatgacca

SEQ ID NO: 818005 - DNA, 20 bp, Artificial
  CRISPR gRNA sequence
atccctaaatatggtgtccc

SEQ ID NO: 818006 - DNA, 20 bp, Artificial
  CRISPR gRNA sequence
tccctaaatatggtgtccct

SEQ ID NO: 818007 - DNA, 20 bp, Artificial
  CRISPR gRNA sequence
gtgatccgggtatgggcagt

SEQ ID NO: 818008 - DNA, 20 bp, Homo sapiens
tgatccgggtatgggcagtg

SEQ ID NO: 818009 - DNA, 49 bp, Homo sapiens
acaggttgtcggtggaagggacaggggtgacgggtatgggcctagtgga

SEQ ID NO: 818010 - DNA, 49 bp, Homo sapiens
tgtccaacagccaccttccctgtccccactgcccatacccggatcacct

SEQ ID NO: 818011 - DNA, 47 bp, Homo sapiens
ttatccctaaatatggtgtccctgggacagctggccctccctgctgg

SEQ ID NO: 818012 - DNA, 43 bp, Homo sapiens
aacagccaccttccctgtccccacagctggccctccctgctgg

SEQ ID NO: 818013 - DNA, 40 bp, Homo sapiens
tgtccaacagccaccttccccctgggacagctggccctcc

SEQ ID NO: 818014 - DNA, 205 bp, Homo sapiens
  misc_feature (195)..(195): n is a, c, g, or t
ctcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgtgnccctggctgt

SEQ ID NO: 818015 - DNA, 205 bp, Homo sapiens
ctcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgt

SEQ ID NO: 818016 - DNA, 203 bp, Homo sapiens
  misc_feature (7)..(7): n is a, c, g, or t
  misc_feature (15)..(15): n is a, c, g, or t
  misc_feature (17)..(17): n is a, c, g, or t
  misc_feature (58)..(58): n is a, c, g, or t
agaccangacacggngntcgtggagaccaggcctgcaggggatggaaccttccagaantgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctgg

SEQ ID NO: 818017 - DNA, 204 bp, Artificial
  CRISPR gRNA sequence
agacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctgg

SEQ ID NO: 818018 - DNA, 19 bp, Artificial
  CRISPR gRNA sequence
agcgcaagtgggaggcggc

SEQ ID NO: 818019 - DNA, 20 bp, Homo sapiens
cggctcgtgggctgcatgtg

SEQ ID NO: 818020 - DNA, 57 bp, Homo sapiens
aaaattcaggacccggtgtacgtcgggtgctcggcgcccaacctgttcggacgtaga

SEQ ID NO: 818021 - DNA, 57 bp, Homo sapiens
ttttaagtcctgggccacatgcagcccacgagccgcgggttggacaagcctgcatct

SEQ ID NO: 818022 - DNA, 51 bp, Homo sapiens
ccggcggagggtgaacgcgacccattagactcggcggtaccggcggcgcca

SEQ ID NO: 818023 - DNA, 51 bp, Homo sapiens
ggccgcctcccacttgcgctgggtaatctgagccgccatggccgccgcggt

SEQ ID NO: 818024 - DNA, 52 bp, Homo sapiens
gtcctgggccacatgcagcccacgagatctgagccgccatggccgccgcggt

SEQ ID NO: 818025 - protein, 27 aa, Homo sapiens
YLELLNSDADPLCLYHFYDQMDLAGEE

SEQ ID NO: 818026 - DNA, 81 bp, Homo sapiens
tacctggagcttcttaacagcgatgctgaccccctgtgcctctaccacttctatgaccagatggacctggctggagaagaa

SEQ ID NO: 818027 - DNA, 70 bp, Homo sapiens
tacctggagcttcttaacagcgatgtgcctctaccacttctatgaccagatggacctggctggagaagaa

SEQ ID NO: 818028 - DNA, 48 bp, Homo sapiens
tacctggagcttcttaacagcgaccagatggacctggctggagaagaa

SEQ ID NO: 818029 - DNA, 74 bp, Homo sapiens
tacctggagcttcttaacagcgatgctgacgcctctaccacttctatgaccagatggacctggctggagaagaa

SEQ ID NO: 818030 - DNA, 73 bp, Homo sapiens
tacctggagcttcttaacagcgatgctgaccctctaccacttctatgaccagatggacctggctggagaagaa

SEQ ID NO: 818031 - DNA, 71 bp, Homo sapiens
tacctggagcttcttaacagcgatgctgactctaccacttctatgaccagatggacctggctggagaagaa

SEQ ID NO: 818032 - DNA, 67 bp, Homo sapiens
tacctggagcttcttaacagcgatgctctaccacttctatgaccagatggacctggctggagaagaa

SEQ ID NO: 818033 - DNA, 70 bp, Homo sapiens
tacctggagcttcttaacagcgatgctgaccccctgtgcctatgaccagatggacctggctggagaagaa

SEQ ID NO: 818034 - DNA, 73 bp, Homo sapiens
tacctggagcttcttaacagcgatgctgaccccctaccacttctatgaccagatggacctggctggagaagaa

SEQ ID NO: 818035 - DNA, 64 bp, Homo sapiens
tacctggagcttcttaacagcgatgctgaccccctatgaccagatggacctggctggagaagaa

SEQ ID NO: 818036 - DNA, 78 bp, Homo sapiens
tacctggagcttcttaacagcgatgctgaccccctgctctaccacttctatgaccagatggacctggctggagaagaa

SEQ ID NO: 818037 - DNA, 62 bp, Homo sapiens
tacctggagcttcttaacagcgatgctgaccctatgaccagatggacctggctggagaagaa

SEQ ID NO: 818038 - DNA, 66 bp, Homo sapiens
tacctggagcttcttaacagcgatgctgaccccctctatgaccagatggacctggctggagaagaa

SEQ ID NO: 818039 - DNA, 54 bp, Homo sapiens
tacctggagcttctctaccacttctatgaccagatggacctggctggagaagaa

SEQ ID NO: 818040 - DNA, 36 bp, Homo sapiens
cacttctatgaccagatggacctggctggagaagaa

SEQ ID NO: 818041 - DNA, 80 bp, Homo sapiens
tacctggagcttcttaacagcgatgctgaccccctgtacccctctacccccctctaccacttctatgaccagatggacct

SEQ ID NO: 818042 - protein, 15 aa, Homo sapiens
WSCLVRLLTKDPEWL

SEQ ID NO: 818043 - DNA, 39 bp, Homo sapiens
ggagctgtcttgtgaggctgctcaacccagaatggctga

SEQ ID NO: 818044 - DNA, 41 bp, Homo sapiens
ggagctgtcttgtgaggctgctcaagacccagaatggctga

SEQ ID NO: 818045 - DNA, 21 bp, Homo sapiens
ggagctgtcttgtgaggctga

SEQ ID NO: 818046 - DNA, 45 bp, Homo sapiens
ggagctgtcttgtgaggctgcccaccaaagacccagaatggctga

SEQ ID NO: 818047 - DNA, 45 bp, Homo sapiens
ggggctgtcttgtgaggctgctcaccaaagacccagaatggctga

SEQ ID NO: 818048 - DNA, 30 bp, Homo sapiens
ggagctgtcttaaagacccagaatggctga

SEQ ID NO: 818049 - DNA, 45 bp, Homo sapiens
ggagctgtcttatgaggctgctcaccaaagacctagaatggctga

SEQ ID NO: 818050 - DNA, 21 bp, Homo sapiens
ggagctgtcttgtgaggctga

SEQ ID NO: 818051 - protein, 15 aa, Homo sapiens
WSCLVRLLTKDPEWL

SEQ ID NO: 818052 - DNA, 28 bp, Homo sapiens
ggagctgtcaaagacccagaatggctga

SEQ ID NO: 818053 - DNA, 27 bp, Homo sapiens
ggagctccaaagacccagaatggctga

SEQ ID NO: 818054 - DNA, 49 bp, Homo sapiens
ggagctgtcttgtgaggctgctcactcaccaaagacccagaatggctga

SEQ ID NO: 818055 - DNA, 45 bp, Homo sapiens
ggagctgtcttgtgagactgctcaccaaagacccagaatggctga

SEQ ID NO: 818056 - DNA, 22 bp, Homo sapiens
ggagctgtcccagaatggctga

SEQ ID NO: 818057 - DNA, 31 bp, Homo sapiens
ggagctgtcttgtgaggcccagaatggctga

SEQ ID NO: 818058 - DNA, 25 bp, Homo sapiens
ggagctgtctacccagaatggctga

SEQ ID NO: 818059 - DNA, 41 bp, Homo sapiens
ggagctgtcttgtgaggctgccaaagacccagaatggctga

SEQ ID NO: 818060 - DNA, 37 bp, Homo sapiens
ggagctgtcttgtgaggcaaagacccagaatggctga

SEQ ID NO: 818061 - DNA, 19 bp, Homo sapiens
ggagacccagaatggctga

SEQ ID NO: 818062 - DNA, 49 bp, Homo sapiens; identical to SEQ ID NO: 818054

SEQ ID NO: 818063 - protein, 27 aa, Homo sapiens
YLELLNSDADPLCLYHFYDQMDLAGEE

SEQ ID NO: 818064 - DNA, 81 bp, Homo sapiens; identical to SEQ ID NO: 818026

SEQ ID NO: 818065 - DNA, 67 bp, Homo sapiens
tacctggagcttcttaacagcgatgctgacccacttctatgaccagatggacctggctggagaagaa

SEQ ID NO: 818066 - DNA, 67 bp, Homo sapiens
tacctggagcttcttaacagcgatgctgacccccttctatgaccagatggacctggctggagaagaa

SEQ ID NO: 818067 - DNA, 46 bp, Homo sapiens
tacctggagcttcttaacagcgatgctggacctggctggagaagaa

SEQ ID NO: 818068 - DNA, 46 bp, Homo sapiens
tacctggagcttcttaacagcgatgctggacctagctggagaagaa

SEQ ID NO: 818069 - DNA, 81 bp, Homo sapiens
tacctggagcttcttaacagcgatgctgaccccctgtgcgtgcctctaccacttctatgaccagatggacctggctggaga

SEQ ID NO: 818070 - DNA, 68 bp, Homo sapiens
tacctggagcttcttaacagcgatgcctctaccacttctatgaccagatggacctggctggagaagaa

SEQ ID NO: 818071 - DNA, 81 bp, Homo sapiens
tacctggagcttcttaacagcgatgctgaccccctgtacccctctacccccctctaccacttctatgaccagatggacctg

SEQ ID NO: 818072 - DNA, 67 bp, Homo sapiens; identical to SEQ ID NO: 818032

SEQ ID NO: 818073 - DNA, 81 bp, Homo sapiens; identical to SEQ ID NO: 818026

SEQ ID NO: 818074 - DNA, 71 bp, Homo sapiens; identical to SEQ ID NO: 818031

SEQ ID NO: 818075 - DNA, 75 bp, Homo sapiens
tacctggagcttcttaacagcgatgctgaccccctgtgccacttctatgaccagatggacctggctggagaagaa

SEQ ID NO: 818076 - DNA, 75 bp, Homo sapiens
tacctggagcttcttaacagcgatgctgaccccctctaccacttctatgaccagatggacctggctggagaagaa

SEQ ID NO: 818077 - DNA, 81 bp, Homo sapiens; identical to SEQ ID NO: 818026

SEQ ID NO: 818078 - DNA, 66 bp, Homo sapiens
tacctggagcttcttaacagcgatgctctaccgcttctatgaccagatggacctggctggagaaga

SEQ ID NO: 818079 - DNA, 81 bp, Homo sapiens
tacctggagcttcttaacagcgatgctgaccccctgtgcctccaccacttctatgaccagatggacctggctggagaagaa

SEQ ID NO: 818080 - DNA, 67 bp, Homo sapiens; identical to SEQ ID NO: 818066

SEQ ID NO: 818081 - DNA, 81 bp, Homo sapiens
tacctggagcttcttaacagcgatgctgaccccctggtagaccccctggtctaccacttctatgaccagatggacctggct

SEQ ID NO: 818082 - DNA, 81 bp, Homo sapiens
tacctggagcttcttaacagcgatgctgaccccctgcgcctctaccacttctatgaccagatggacctggctggagaagaa

SEQ ID NO: 818083 - DNA, 76 bp, Homo sapiens
tacctggagcttcttaacagcgatgctgacccccttctaccacttctatgaccagatggacctggctggagaagaa

SEQ ID NO: 818084 - DNA, 72 bp, Homo sapiens
tacctggagcttcttaacagcgatgctgacccccaccacttctatgaccagatggacctggctggagaagaa

SEQ ID NO: 818085 - DNA, 81 bp, Homo sapiens; identical to SEQ ID NO: 818026

SEQ ID NO: 818086 - DNA, 60 bp, Homo sapiens
ccaaagacccagaatggctgaacgccaagatgaagttcttcctccccaacacggacctgg

SEQ ID NO: 818087 - DNA, 58 bp, Homo sapiens
ccaaagacccagaatggctgaacgccaatgaagttcttcctccccaacacggacctgg

SEQ ID NO: 818088 - protein, 25 aa, Homo sapiens
QVLLIFDGLDEALQPMGPDGPGPVL

SEQ ID NO: 818089 - DNA, 20 bp, Homo sapiens
gatgaggccctccagcctat

SEQ ID NO: 818090 - DNA, 77 bp, Homo sapiens
ccaagtcctgctgatctttgatgggctagatgaggccctccagcctatgggtcctgatggcccaggcccagtcctca

SEQ ID NO: 818091 - DNA, 66 bp, Homo sapiens
ccaagtcctgctgatctttgatgggctagatgaggccctccagcccaggcccaggcccagtcctca

SEQ ID NO: 818092 - protein, 24 aa, Homo sapiens
SVALAVLALLSLSGLRAIQRTPKI

SEQ ID NO: 818093 - DNA, 20 bp, Homo sapiens
gctactctctctttctggcc

SEQ ID NO: 818094 - DNA, 70 bp, Homo sapiens
ccgtggccttagctgtgctcgcgctactctctctttctggcctggaggctatccagcgtactccaaagat

SEQ ID NO: 818095 - DNA, 65 bp, Homo sapiens
ccgtggccttagctgtgctcgcgctactctctctttctggaggctatccagcgtactccaaagat

SEQ ID NO: 818096 - protein, 26 aa, Homo sapiens
YLELLNSDADPLCLYHFYDQMDLAGE

SEQ ID NO: 818097 - DNA, 78 bp, Homo sapiens
tacctggagcttcttaacagcgatgctgaccccctgtgcctctaccacttctatgaccagatggacctggctggagaa

SEQ ID NO: 818098 - DNA, 64 bp, Homo sapiens
tacctggagcttcttaacagcgatgctgacccacttctatgaccagatggacctggctggagaa

SEQ ID NO: 818099 - protein, 26 aa, Homo sapiens
YLELLNSDADPLCLYHFYDQMDLAGE

SEQ ID NO: 818100 - DNA, 20 bp, Homo sapiens
cttctatgaccagatggacc

SEQ ID NO: 818101 - DNA, 78 bp, Homo sapiens; identical to SEQ ID NO: 818097

SEQ ID NO: 818102 - DNA, 76 bp, Homo sapiens
tacctggagcttcttaacagcgatgctgaccccctgtgcctctaccacttatgaccagatggacctggctggagaa

SEQ ID NO: 818103 - DNA, 71 bp, Artificial
  CRISPR gRNA sequence
tacctggagcttcttaacagcgatgctgaccccctgtgcctctaccaggccagatggacctggctggagaa

SEQ ID NO: 818104 - DNA, 23 bp, Artificial
  CRISPR gRNA sequence
ggtccatctggtcatagaagtgg

SEQ ID NO: 818105 - DNA, 24 bp, Artificial
  CRISPR gRNA sequence
gatgtccagggttcggacacctgg

SEQ ID NO: 818106 - DNA, 23 bp, Artificial
  CRISPR gRNA sequence
gatgaggccctccagcctatggg

SEQ ID NO: 818107 - DNA, 21 bp, Artificial
  CRISPR gRNA sequence
gatgcctgtttgttccggagc

SEQ ID NO: 818108 - DNA, 21 bp, Artificial
  CRISPR gRNA sequence
gagatgatcttccagatccca

SEQ ID NO: 818109 - DNA, 21 bp, Artificial
  CRISPR gRNA sequence
gctcggatgcgcatgagaccc

SEQ ID NO: 818110 - DNA, 21 bp, Artificial
  CRISPR gRNA sequence
gctcatgcgcatccgagtgat

SEQ ID NO: 818111 - DNA, 21 bp, Artificial
  CRISPR gRNA sequence
gagatgatcttccagatccca

SEQ ID NO: 818112 - DNA, 21 bp, Homo sapiens
gctcggatgcgcatgagaccc

SEQ ID NO: 818113 - DNA, 25 bp, Homo sapiens
ctcggatgcgcatgagaccctggct

SEQ ID NO: 818114 - DNA, 26 bp, Homo sapiens
gagatgatcttccagatcccatggaa

SEQ ID NO: 818115 - DNA, 55 bp, Homo sapiens
  misc_feature (51)..(51): n is a, c, g, or t
  misc_feature (54)..(55): n is a, c, g, or t
atgcccatcactcggatgcgcatgagaccatggaagcatgctgccaagcanggnn

SEQ ID NO: 818116 - DNA, 46 bp, Homo sapiens
caggaggagatgatcttccagatcccatggaagcatgctgccaagc

SEQ ID NO: 818117 - DNA, 39 bp, Homo sapiens
caggaggagatgatcttccatggaagcatgctgccaagc

SEQ ID NO: 818118 - DNA, 57 bp, Homo sapiens
  misc_feature (1)..(1): n is a, c, g, or t
ngaggagatgatcttccatggaagcatgctgccaagcatggctgggacatcaacaag

SEQ ID NO: 818119 - DNA, 46 bp, Homo sapiens; identical to SEQ ID NO: 818116

SEQ ID NO: 818120 - DNA, 45 bp, Homo sapiens
caggaggagatgatcttccagatccatggaagcatgctgccaagc

SEQ ID NO: 818121 - DNA, 49 bp, Homo sapiens
  misc_feature (1)..(2): n is a, c, g, or t
nngaggagatgatcttccagatccatggaagcatgctgccaagcatggc

SEQ ID NO: 818122 - DNA, 46 bp, Homo sapiens; identical to SEQ ID NO: 818116

SEQ ID NO: 818123 - DNA, 52 bp, Homo sapiens
caggaggagatgatcttccagatcatgctgccatggaagcatgctgccaagc

SEQ ID NO: 818124 - DNA, 55 bp, Artificial
  CRISPR gRNA sequence
  misc_feature (4)..(4): n is a, c, g, or t
  misc_feature (7)..(7): n is a, c, g, or t
gganganatgatcttccaatcatgctgccatggaacatgctgccaagcatggctg

SEQ ID NO: 818125 - DNA, 20 bp, Artificial
  CRISPR gRNA sequence
gtcttggggctcttagcatc

SEQ ID NO: 818126 - DNA, 20 bp, Artificial
  CRISPR gRNA sequence
acccttcttcagaggctccg

SEQ ID NO: 818127 - DNA, 20 bp, Artificial
  CRISPR gRNA sequence
gggctagaattgagagggac

SEQ ID NO: 818128 - DNA, 20 bp, Artificial
  CRISPR gRNA sequence
ggagtgccctggggccttct

SEQ ID NO: 818129 - DNA, 20 bp, Artificial
  CRISPR gRNA sequence
gcaggctgggtaagctccat

SEQ ID NO: 818130 - DNA, 20 bp, Artificial
  CRISPR gRNA sequence
tgcaaggctaggtatgcagt

SEQ ID NO: 818131 - DNA, 20 bp, Artificial
  CRISPR gRNA sequence
gacccctgcctcagaacttg

SEQ ID NO: 818132 - DNA, 20 bp, Artificial
  CRISPR gRNA sequence
ctgtgagggtgggtaaactg

SEQ ID NO: 818133 - DNA, 20 bp, Artificial
  CRISPR gRNA sequence
ttggttcgcgaagtgccgtt

SEQ ID NO: 818134 - DNA, 20 bp, Artificial
  CRISPR gRNA sequence
acttcgcgaaccaaagactc

SEQ ID NO: 818135 - DNA, 20 bp, Artificial
  CRISPR gRNA sequence
cgcggggtggggcacgccgc

SEQ ID NO: 818136 - DNA, 20 bp, Artificial
  CRISPR gRNA sequence
accgaggctggcgccaaggt

SEQ ID NO: 818137 - DNA, 20 bp, Artificial
  CRISPR gRNA sequence
agtgtacctcacagccttct

SEQ ID NO: 818138 - DNA, 20 bp, Artificial
  CRISPR gRNA sequence
gacagagcagattgttgtcc

SEQ ID NO: 818139 - DNA, 20 bp, Artificial
  CRISPR gRNA sequence
agtgagattcctgtccactc

SEQ ID NO: 818140 - DNA, 20 bp, Artificial
  CRISPR gRNA sequence
gacagattcagcagcaggta

SEQ ID NO: 818141 - DNA, 20 bp, Artificial
  CRISPR gRNA sequence
agcaaagcctacagtcgttc

SEQ ID NO: 818142 - DNA, 20 bp, Artificial
  CRISPR gRNA sequence
gttgtcgagatgtccacaga

SEQ ID NO: 818143 - DNA, 20 bp, Artificial
  CRISPR gRNA sequence
tcagactttctgtccagatt

SEQ ID NO: 818144 - DNA, 20 bp, Artificial
  CRISPR gRNA sequence
tcctcaccactgttaaattc

SEQ ID NO: 818145 - DNA, 20 bp, Artificial
  CRISPR gRNA sequence
gtgagcgcttagtatttacc

SEQ ID NO: 818146 - DNA, 20 bp, Artificial
  CRISPR gRNA sequence
accagcacatagcatgaacc

SEQ ID NO: 818147 - DNA, 20 bp, Artificial
  CRISPR gRNA sequence
gtagctgtcaacaacagaca

SEQ ID NO: 818148 - DNA, 20 bp, Artificial
  CRISPR gRNA sequence
accaggttcatgctatgtgc

SEQ ID NO: 818149 - DNA, 23 bp, Artificial
  CRISPR gRNA sequence
ttggcactcggacgccgtcccgg

SEQ ID NO: 818150 - DNA, 23 bp, Artificial
  CRISPR gRNA sequence
tcggcggtacccggagcttcagg

SEQ ID NO: 818151 - DNA, 23 bp, Artificial
  CRISPR gRNA sequence
ccgggtccgcggatagcaccagg

SEQ ID NO: 818152 - DNA, 23 bp, Homo sapiens
tggtgctatccgcggacccgggg

SEQ ID NO: 818153 - DNA, 297 bp, Homo sapiens
gcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagc

SEQ ID NO: 818154 - DNA, 297 bp, Homo sapiens
gcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagc

SEQ ID NO: 818155 - DNA, 297 bp, Homo sapiens
gcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagc

SEQ ID NO: 818156 - DNA, 297 bp, Homo sapiens
gcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagc

SEQ ID NO: 818157 - DNA, 297 bp, Homo sapiens
gcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagc

SEQ ID NO: 818158 - DNA, 197 bp, Homo sapiens
gcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggag

SEQ ID NO: 818159 - DNA, 197 bp, Homo sapiens
gcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgag

SEQ ID NO: 818160 - DNA, 197 bp, Homo sapiens
gcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgag

SEQ ID NO: 818161 - DNA, 197 bp, Homo sapiens
gcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggag

SEQ ID NO: 818162 - DNA, 197 bp, Artificial
  Razor guide sequence
gcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggag

SEQ ID NO: 818163 - DNA, 23 bp, Artificial
  Razor guide
aggtcagtgtgatctccgcaggg

SEQ ID NO: 818164 - DNA, 23 bp, Artificial
  CRISPR gRNA sequence
cagggcccagcacctcagggtgg

SEQ ID NO: 818165 - DNA, 23 bp, Artificial
  CRISPR gRNA sequence
agagcaacagtgctgtggcctgg

SEQ ID NO: 818166 - DNA, 23 bp, Artificial
  CRISPR gRNA sequence
tggaataatgctgttgttgaagg

SEQ ID NO: 818167 - DNA, 23 bp, Artificial
  CRISPR gRNA sequence
cgctgtcaagtccagttctacgg

SEQ ID NO: 818168 - DNA, 23 bp, Artificial
  CRISPR gRNA sequence
ggctctcggagaatgacgagtgg

SEQ ID NO: 818169 - DNA, 23 bp, Artificial
  CRISPR gRNA sequence
ggtagaaaaacaattagacctgg

SEQ ID NO: 818170 - DNA, 20 bp, Artificial
  CRISPR gRNA sequence
gtagccgactgcagatagga

SEQ ID NO: 818171 - DNA, 20 bp, Artificial
  CRISPR gRNA sequence
cctctgagaaaagacggtct

SEQ ID NO: 818172 - DNA, 20 bp, Artificial
  CRISPR gRNA sequence
tcaggccttacctgaggcga

SEQ ID NO: 818173 - DNA, 20 bp, Artificial
  CRISPR gRNA sequence
ggctcccctcgcctcaggta

SEQ ID NO: 818174 - DNA, 20 bp, Artificial
  CRISPR gRNA sequence
cttacaagtaagtctcggca

SEQ ID NO: 818175 - DNA, 20 bp, Artificial
  CRISPR gRNA sequence
gaagaagtacccagtccatt

SEQ ID NO: 818176 - DNA, 20 bp, Artificial
  CRISPR gRNA sequence
gacataatggtgctgtacag

SEQ ID NO: 818177 - DNA, 20 bp, Artificial
  CRISPR gRNA sequence
gttaaaactgtgcctaacag

SEQ ID NO: 818178 - DNA, 20 bp, Artificial
  CRISPR gRNA sequence
agcctcaagacgtcggtttt

SEQ ID NO: 818179 - DNA, 20 bp, Artificial
  CRISPR gRNA sequence
agctcgggaacccagctagc

SEQ ID NO: 818180 - DNA, 20 bp, Artificial
  CRISPR gRNA sequence
ggatctgcgagcagacggag

SEQ ID NO: 818181 - DNA, 20 bp, Artificial
  CRISPR gRNA sequence
ggaactcagcgccattgctg

SEQ ID NO: 818182 - DNA, 20 bp, Artificial
  CRISPR gRNA sequence
ccagtcagcaagaggacgat

SEQ ID NO: 818183 - DNA, 20 bp, Artificial
  CRISPR gRNA sequence
aaggaggtcctacctggcgt

SEQ ID NO: 818184 - DNA, 20 bp, Artificial
  CRISPR gRNA sequence
accagactctctgccgtgca

SEQ ID NO: 818185 - DNA, 20 bp, Artificial
  CRISPR gRNA sequence
cctgctcctcaaggtgtatc

SEQ ID NO: 818186 - DNA, 20 bp, Artificial
  CRISPR gRNA sequence
tggaaccctagcccatcgtc

SEQ ID NO: 818187 - DNA, 20 bp, Artificial
  CRISPR gRNA sequence
ctcacacttcgggttcctcg

SEQ ID NO: 818188 - DNA, 20 bp, Artificial
  CRISPR gRNA sequence
attttttgaggtcttccaat

SEQ ID NO: 818189 - DNA, 20 bp, Artificial
  CRISPR gRNA sequence
tacctgttacttgaattgaa

SEQ ID NO: 818190 - DNA, 20 bp, Artificial
  CRISPR gRNA sequence
ccttgcggggtgtggctata

SEQ ID NO: 818191 - DNA, 20 bp, Artificial
  CRISPR gRNA sequence
tggggctgagcaccgtgacg

SEQ ID NO: 818192 - DNA, 20 bp, Artificial
  CRISPR gRNA sequence
gcagagccgcacacggcccg

SEQ ID NO: 818193 - DNA, 20 bp, Artificial
  CRISPR gRNA sequence
tctctgctgtcgccagagtc

SEQ ID NO: 818194 - DNA, 20 bp, Artificial
  CRISPR gRNA sequence
atggtccggttcttgtactc

SEQ ID NO: 818195 - DNA, 20 bp, Artificial
  CRISPR gRNA sequence
tggcacaaactcgcatctac

SEQ ID NO: 818196 - DNA, 20 bp, Artificial
  CRISPR gRNA sequence
tgtctggggacatgaatata

SEQ ID NO: 818197 - DNA, 20 bp, Artificial
  CRISPR gRNA sequence
ggtcacgtggataacaccta

SEQ ID NO: 818198 - DNA, 20 bp, Artificial
  CRISPR gRNA sequence
gctcttcttcatgtatacag

SEQ ID NO: 818199 - DNA, 20 bp, Artificial
  CRISPR gRNA sequence
cacgactgataacatctgag

SEQ ID NO: 818200 - DNA, 20 bp, Artificial
  CRISPR gRNA sequence
gaaggaaactgcattgtgct

SEQ ID NO: 818201 - DNA, 20 bp, Artificial
  CRISPR gRNA sequence
ggattatcctactttacttt

SEQ ID NO: 818202 - DNA, 20 bp, Artificial
  CRISPR gRNA sequence
ggcacgtggttaagctctcg

SEQ ID NO: 818203 - DNA, 20 bp, Artificial
  CRISPR gRNA sequence
ttgactcttatgcttacctt

SEQ ID NO: 818204 - DNA, 20 bp, Artificial
  CRISPR gRNA sequence
tacatggaaagctcatctta

SEQ ID NO: 818205 - DNA, 20 bp, Artificial
  CRISPR gRNA sequence
agttactgagagtcactttc

SEQ ID NO: 818206 - DNA, 20 bp, Artificial
  CRISPR gRNA sequence
ccttttggagggctcagcgc

SEQ ID NO: 818207 - DNA, 20 bp, Artificial
  CRISPR gRNA sequence
gaccataggagagatgtggg

SEQ ID NO: 818208 - DNA, 20 bp, Artificial
  CRISPR gRNA sequence
gggtggctccaggtaaaacg

SEQ ID NO: 818209 - DNA, 20 bp, Artificial
  CRISPR gRNA sequence
cccgccatccccgttttacc

SEQ ID NO: 818210 - DNA, 20 bp, Artificial
  CRISPR gRNA sequence
ggtcagtttacctaccccag

SEQ ID NO: 818211 - DNA, 20 bp, Artificial
  CRISPR gRNA sequence
tttccatcactgatatgtgc

SEQ ID NO: 818212 - DNA, 20 bp, Artificial
  CRISPR gRNA sequence
cctaagcaggtgccttacca

SEQ ID NO: 818213 - DNA, 20 bp, Artificial
  CRISPR gRNA sequence
taatcccatatctggacatc

SEQ ID NO: 818214 - DNA, 20 bp, Artificial
  CRISPR gRNA sequence
gaagacacccttacctgtac

SEQ ID NO: 818215 - DNA, 20 bp, Artificial
  CRISPR gRNA sequence
cagtcactcatcaaggtaaa

SEQ ID NO: 818216 - DNA, 20 bp, Artificial
  CRISPR gRNA sequence
gttcaatgacaacatcattc

SEQ ID NO: 818217 - DNA, 20 bp, Artificial
  CRISPR gRNA sequence
tagaacagagatcacaagac

SEQ ID NO: 818218 - DNA, 20 bp, Artificial
  CRISPR gRNA sequence
attggcttttgtgcaaaaaa

SEQ ID NO: 818219 - DNA, 20 bp, Artificial
  CRISPR gRNA sequence
cctgctattctagtgtatac

SEQ ID NO: 818220 - DNA, 20 bp, Artificial
  CRISPR gRNA sequence
ttctgaaattgtagcgaaga

SEQ ID NO: 818221 - DNA, 20 bp, Artificial
  CRISPR gRNA sequence
acatactcattttctcaaat

SEQ ID NO: 818222 - DNA, 20 bp, Artificial
  CRISPR gRNA sequence
tcactggcatacgacagtga

SEQ ID NO: 818223 - DNA, 20 bp, Artificial
  CRISPR gRNA sequence
tcgtatgccagtgactcatc

SEQ ID NO: 818224 - DNA, 20 bp, Artificial
  CRISPR gRNA sequence
cttactaaactttgctgctg

SEQ ID NO: 818225 - DNA, 20 bp, Artificial
  CRISPR gRNA sequence
tgataaacagaatggggttt

SEQ ID NO: 818226 - DNA, 20 bp, Artificial
  CRISPR gRNA sequence
cggggcgatgggcgcgtttc

SEQ ID NO: 818227 - DNA, 20 bp, Artificial
  CRISPR gRNA sequence
tgacctgagaatcccgaccc

SEQ ID NO: 818228 - DNA, 20 bp, Artificial
  CRISPR gRNA sequence
ggggacggggcgtgtccaac

SEQ ID NO: 818229 - DNA, 20 bp, Artificial
  CRISPR gRNA sequence
tgagcgcgcacagcagcgcc

SEQ ID NO: 818230 - DNA, 23 bp, Homo sapiens
gctgacagataccaaacagctgg

SEQ ID NO: 818231 - DNA, 56 bp, Homo sapiens
cacagctcaacctcatctggcagctgacagataccaaacagctggtgcacagcttt

SEQ ID NO: 818232 - DNA, 40 bp, Homo sapiens
  misc_feature (14)..(14): n is a, c, g, or t
cacagctcaacctnatctggcagagctggtgcacagcttt

SEQ ID NO: 818233 - DNA, 30 bp, Homo sapiens
cacagctcaacctcatctggtgcacagttt

SEQ ID NO: 818234 - DNA, 23 bp, Homo sapiens
gctactctctctttctggcctgg

SEQ ID NO: 818235 - DNA, 23 bp, Homo sapiens
ccacctcttgatggggctagtag

SEQ ID NO: 818236 - DNA, 33 bp, Homo sapiens
gctactctctctttctcttgatggggctagtag

SEQ ID NO: 818237 - DNA, 23 bp, Homo sapiens
gctgccgcccagtgggactttgg

SEQ ID NO: 818238 - DNA, 23 bp, Homo sapiens
ccaggaatcatctttaccagatc

SEQ ID NO: 818239 - DNA, 33 bp, Artificial
  CRISPR gRNA sequence
gctgccgcccagtgggatcatctttaccagatc

SEQ ID NO: 818240 - DNA, 24 bp, Artificial
  CRISPR gRNA sequence
tttaatataagtggaggcgtcgcg

SEQ ID NO: 818241 - DNA, 24 bp, Artificial
  CRISPR gRNA sequence
tttctggcctggaggctatccagc

SEQ ID NO: 818242 - DNA, 24 bp, Artificial
  Forward primer
tttaatgttatgaaaaaaatcagg

SEQ ID NO: 818243 - DNA, 24 bp, Artificial
  Reverse primer
gagggcctatttcccatgattcct

SEQ ID NO: 818244 - DNA, 66 bp, Homo sapiens
cctttattttagctgaagggaaaatctacaagagtagaaattacggtgtttcgtcctttccacaag

SEQ ID NO: 818245 - DNA, 59 bp, Homo sapiens
tggccttagctgtgctcgcgctactctctctttctggcctggaggctatccagcgtgag

SEQ ID NO: 818246 - DNA, 39 bp, Homo sapiens
tggccttagctgtgctcgcgctactctatccagcgtgag

SEQ ID NO: 818247 - DNA, 41 bp, Homo sapiens
tggccttagctgtgctcgcgctactctctatccagcgtgag

SEQ ID NO: 818248 - DNA, 56 bp, Homo sapiens
tggccttagctgtgctcgcgctactcctttctggcctggaggctatccagcgtgag

SEQ ID NO: 818249 - DNA, 51 bp, Homo sapiens
tggccttagctgtgctcgcgctactctggcctggaggctatccagcgtgag

SEQ ID NO: 818250 - DNA, 23 bp, Homo sapiens
cccaacgggcgtgacttccacat

SEQ ID NO: 818251 - DNA, 23 bp, Homo sapiens
cctggtggttggtgtcgtgggcg

SEQ ID NO: 818252 - DNA, 87 bp, Homo sapiens
gcccggccaggactgccgcttccgtgtcacacaactgcccaacggttggtgtcgtgggcggcctgctgggcagcctggtgctgctag

SEQ ID NO: 818253 - DNA, 23 bp, Homo sapiens
cccaccgccatactacctgggca

SEQ ID NO: 818254 - DNA, 23 bp, Homo sapiens
tccttgcagcagttagttcgggg

SEQ ID NO: 818255 - DNA, 74 bp, Homo sapiens
caaggtggagctcatgtacccaccttcggggttgtttttttatagctttctcctcacagctgtttctttgagca
